(12) United States Patent
Burk et al.

(10) Patent No.: US 7,932,064 B2
(45) Date of Patent: Apr. 26, 2011

(54) PROCESSES FOR MAKING (R)-ETHYL 4-CYANO-3-HYDROXYBUTYRIC ACID

(75) Inventors: Mark J. Burk, San Diego, CA (US); Grace Desantis, San Diego, CA (US); Brian Morgan, San Diego, CA (US); Zoulin Zhu, San Diego, CA (US)

(73) Assignee: Verenium Corporation, San Diego, CA (US)

( * ) Notice: Subject to any disclaimer, the term of this patent is extended or adjusted under 35 U.S.C. 154(b) by 542 days.

(21) Appl. No.: 10/461,925

(22) Filed: Jun. 13, 2003

(65) Prior Publication Data

US 2004/0053378 A1 Mar. 18, 2004

Related U.S. Application Data

(60) Provisional application No. 60/389,317, filed on Jun. 13, 2002, provisional application No. 60/392,944, filed on Jun. 28, 2002.

(51) Int. Cl.
 *C12P 13/00* (2006.01)
 *C12N 9/78* (2006.01)
 *C07H 21/04* (2006.01)
 *C07H 21/02* (2006.01)

(52) U.S. Cl. ....... 435/128; 435/227; 536/23.1; 536/23.2

(58) Field of Classification Search .................. 435/128, 435/183, 6, 69.1, 146, 320.1, 325; 536/23.2
See application file for complete search history.

(56) References Cited

U.S. PATENT DOCUMENTS

| | | | |
|---|---|---|---|
| 4,611,067 A | 9/1986 | Volante | |
| 5,003,080 A | 3/1991 | Butler | |
| 5,097,045 A | 3/1992 | Butler | |
| 5,103,024 A | 4/1992 | Millar | |
| 5,124,482 A | 6/1992 | Butler | |
| 5,149,837 A | 9/1992 | Butler | |
| 5,216,174 A | 6/1993 | Butler | |
| 5,245,047 A | 9/1993 | Butler | |
| 5,248,793 A | 9/1993 | Millar | |
| 5,280,126 A | 1/1994 | Butler | |
| 5,298,627 A | 3/1994 | Butler | |
| 5,342,952 A | 8/1994 | Butler | |
| 5,397,792 A | 3/1995 | Butler | |
| 5,446,054 A | 8/1995 | Butler | |
| 5,470,981 A | 11/1995 | Butler | |
| 5,489,690 A | 2/1996 | Butler | |
| 5,489,691 A | 2/1996 | Butler | |
| 5,510,488 A | 4/1996 | Butler | |
| 5,629,190 A | 5/1997 | Petre | |
| 5,635,391 A | 6/1997 | Petre | |
| 5,872,000 A | 2/1999 | Yu | |
| 5,939,553 A * | 8/1999 | Reichwein et al. | 546/250 |
| 6,433,213 B1 | 8/2002 | Bosch | |
| 6,596,879 B2 | 7/2003 | Bosch | |
| 2003/0044800 A1 | 3/2003 | Connelly | |
| 2004/0014195 A1 * | 1/2004 | DeSantis et al. | 435/228 |

FOREIGN PATENT DOCUMENTS

| | | |
|---|---|---|
| EP | 0 178 106 | 3/1993 |
| WO | 01/48175 A2 | 7/2001 |
| WO | 02/29079 A2 | 4/2002 |
| WO | 03/000840 A2 | 1/2003 |
| WO | WO-03/004456 | 1/2003 |
| WO | WO 03/097810 | 11/2003 |
| WO | 2004/096988 A2 | 11/2004 |

OTHER PUBLICATIONS

Effenberger et al. Selective hydrolysis of aliphatic dinitriles to monocarboxylic acids by a nitrilase from *Arabidopsis thaliana*, Synthesis 2001, 11866-1872.*
Gradley et al. Biotechnol Letters, 16(1): 41-46, 1994.*
International Search Report mailed on May 12, 2004, for PCT patent application No. PCT/US03/18840, filed on Jun. 13, 2002, 3 pages.
Baumann et al., Tetrahedron Letters (1992) 33:2283-2284.
Brower et al., Tetrahedron Letters (1992) 33:2279-2282.
Cohen et al., Tetrahedron Letters (1990) 31:7223-7226.
Gavagan et al., J. Org. Chem. (1998) 63:4792-4801.
Kobayashi et al., Tetrahedron (1990) 46:5587-5590.
Robertson—Applied and Environmental Microbiology (2004)—70—2429-2436.
EP08731180—Extended European Search Report—Jul. 2, 2010.
EP03753097—Office Action—Aug. 11, 2010.
EP03753097—Supplementary Partial EP Search Report—Sep. 21, 2007.

\* cited by examiner

*Primary Examiner* — Anand U Desai
*Assistant Examiner* — Iqbal H Chowdhury (57) ABSTRACT

The invention provides novel processes for making ethyl-4-cyano-3-hydroxybutyrate, e.g., (R)-ethyl 4-cyano-3-hydroxybutyric acid, and 4-cyano-3-hydroxybutyric acid. The invention provides protocols for making and 4-cyano-3-hydroxybutyric acid and ethyl-4-cyano-3-hydroxybutyrate by whole cell processes, cell lysate processes, "one pot processes" and "multi-pot" processes using a variety of parameters.

32 Claims, 1 Drawing Sheet

FIGURE 1

PROCESSES FOR MAKING (R)-ETHYL 4-CYANO-3-HYDROXYBUTYRIC ACID

CROSS-REFERENCES TO RELATED APPLICATIONS

This application claims the benefit of priority under 35 U.S.C. §119(e) of U.S. Provisional patent application Ser. No. (U.S. Ser. No.) 60/389,317, filed Jun. 13, 2002, and U.S. Ser. No. 60/392,944, filed Jun. 28, 2002. These applications are hereby incorporated by reference into the subject application in their entireties for all purposes.

TECHNICAL FIELD

This invention relates to synthetic chemistry. In alternative aspects, the invention provides novel processes for making an ethyl-4-cyano-3-hydroxybutyrate, e.g., (R)-ethyl-4-cyano-3-hydroxybutyrate, and a 4-cyano-3-hydroxybutyric acid. The invention provides protocols for making and 4-cyano-3-hydroxybutyric acid and ethyl-4-cyano-3-hydroxybutyrate by whole cell processes, cell lysate processes, "one pot processes" and "multi-pot" processes using a variety of parameters.

BACKGROUND

Atorvastatin, e.g., LIPITOR™, is used as a selective and competitive inhibitor of the enzyme 3-hydroxy-3-methylglutaryl-coenzyme A (HMG-CoA) reductase, the rate-limiting enzyme that converts 3-hydroxy-3-methylglutaryl-coenzyme A to mevalonate, a precursor of sterols such as cholesterol. The conversion of HMG-CoA to mevalonate is an early and rate-limiting step in cholesterol biosynthesis. Atorvastatin is indicated, in conjunction with dietary restriction, in the management of hyperlipidemia, including hypercholesterolemia, mixed dyslipidemia, and homozygous familial hypercholesterolemia.

(R)-ethyl 4-cyano-3-hydroxybutyrate is a key intermediate in the synthesis of atorvastatin.

Crosby, John A.; Parratt, Julian S.; Turner, Nicholas J., Dep. Chem., Univ. Exeter, Exeter, UK. Tetrahedron: Asymmetry (1992), 3(12), 1547-1550, reported enzymatic hydrolysis of prochiral dinitriles, where a series of prochiral 3-hydroxyglutaronitrile derivatives were enzymatically hydrolyzed to corresponding nitrile-carboxylic acids with enantiomeric excesses of 22% to 84%. The products were of the (S)-configuration in all cases.

Effenberger, Franz; Osswald, Steffen., Institut fur Organische Chemie, Universitat Stuttgart, Stuttgart, Germany. Synthesis (2001), (12), 1866-1872, reported selective hydrolysis of aliphatic dinitriles to monocarboxylic acids by a nitrilase from *Arabidopsis thaliana* expressed in *E. coli*. Conversion rate and selectivity of the hydrolysis of dinitriles w-cyanocarboxylic acids depended on the chain length.

SUMMARY

The invention provides a novel process for a key intermediate to atorvastatin (e.g., LIPITOR™), or (R)-ethyl 4-cyano-3-hydroxybutyrate ((R)-ethyl 4-cyano-3-hydroxybutyric acid). In one aspect, the process of the invention uses epichlorohydrin as starting material and yields the target product (R)-ethyl 4-cyano-3-hydroxybutyric acid (i.e., (R)-ethyl 4-cyano-3-hydroxybutyrate). In one aspect, the processes of the invention yield a product with a chiral purity of more than 99% ee.

The invention provides protocols for making (R)-ethyl-4-cyano-3-hydroxybutyrate by both "one pot processes" and "multi-pot" processes using a variety of parameters, as described herein.

The invention provides methods for making 4-cyano-3-hydroxybutyric acid comprising the following steps: (a) providing a 3-hydroxyglutaronitrile, or equivalent; (b) providing a polypeptide having a nitrilase activity; and (c) catalyzing the conversion of the 3-hydroxyglutaronitrile, or equivalent to 4-cyano-3-hydroxybutyric acid by contacting the 3-hydroxyglutaronitrile, or equivalent, with the polypeptide having a nitrilase activity.

The invention provides methods for making 4-cyano-3-hydroxybutyric acid comprising the following steps (a) providing an epichlorohydrin, or equivalent; (b) providing a polypeptide having a nitrilase activity; (c) converting the epichlorohydrin to 3-hydroxyglutaronitrile; and (d) catalyzing the conversion of the 3-hydroxyglutaronitrile to 4-cyano-3-hydroxybutyric acid by contacting the 3-hydroxyglutaronitrile with the polypeptide having a nitrilase activity.

The invention provides methods for making ethyl-4-cyano-3-hydroxybutyric acid comprising the following steps (a) providing a 3-hydroxyglutaronitrile, or equivalent; (b) providing a polypeptide having a nitrilase activity; (c) catalyzing the conversion of the 3-hydroxyglutaronitrile, or equivalent to 4-cyano-3-hydroxybutyric acid by contacting the 3-hydroxyglutaronitrile, or equivalent, with the polypeptide having a nitrilase activity; and (d) converting the 4-cyano-3-hydroxybutyric acid to ethyl-4-cyano-3-hydroxybutyric acid.

The invention provides methods for making atorvastatin comprising the following steps (a) providing a 3-hydroxyglutaronitrile, or equivalent; (b) providing a polypeptide having a nitrilase activity; (c) catalyzing the conversion of the 3-hydroxyglutaronitrile, or equivalent to 4-cyano-3-hydroxybutyric acid by contacting the 3-hydroxyglutaronitrile, or equivalent, with the polypeptide having a nitrilase activity; (d) converting the 4-cyano-3-hydroxybutyric acid to ethyl-4-cyano-3-hydroxybutyric acid; and (e) converting the ethyl-4-cyano-3-hydroxybutyric acid to atorvastatin.

In one aspect, the epichlorohydrin is converted to 3-hydroxyglutaronitrile by cyanide treatment.

In one aspect, the polypeptide having a nitrilase activity is a nitrilase, or, a catalytic antibody. In one aspect, the polypeptide having a nitrilase activity is a peptidomimetic.

In one aspect, the polypeptide having a nitrilase activity is affixed to a solid support, e.g., glass, ceramic, quartz, Sepharose, gelatin, glutaraldehyde, chitosan-treated glutaraldehyde, albumin-glutaraldehyde, chitosan-Xanthan, toyopearl gel (polymer gel), alginate, alginate-polylysine, carrageenan, agarose, glyoxyl agarose, magnetic agarose, dextran-agarose, poly(Carbamoyl Sulfonate) hydrogel, BSA-PEG hydrogel, phosphorylated polyvinyl alcohol (PVA), monoaminoethyl-N-aminoethyl (MANA), amino, or any combination thereof.

In one aspect, the methods further comprise isolating the 4-cyano-3-hydroxybutyric acid by precipitation with calcium hydroxide. In one aspect, the methods further comprise a step of isolating the 4-cyano-3-hydroxybutyric acid by distillation, column chromatography, crystallization or precipitation. In one aspect, the precipitation step comprises a $Ca^{2+}$ salt precipitation, e.g., where the calcium salt comprises $CaCl_2$. In one aspect, the crystallization step comprises use of a potassium salt, a sodium salt, a lithium salt, a rubidium salt, a cesium salt, a monovalent salt or a divalent metal salt.

In one aspect, the methods further comprise one or more steps of recrystallizing the 4-cyano-3-hydroxybutyric acid. In one aspect, the iterative recrystallizing results in product with progressively higher degrees of enantiospecificity, e.g., 95% ee, 99% ee, 99.5% ee or higher. In one aspect, the recrystallization step comprises use of a sodium salt, a lithium salt, a rubidium salt, a cesium salt, a monovalent salt or a divalent metal salt.

In one aspect, the methods further comprise conversion of the 4-cyano-3-hydroxybutyric acid to ethyl-4-cyano-3-hydroxybutyric acid. In one aspect, the methods further comprise conversion of the 4-cyano-3-hydroxybutyric acid to ethyl-4-cyano-3-hydroxybutyric acid by esterification. In one aspect, the esterification comprises a Fisher esterification reaction, a transesterification reaction or an esterification under Mitsunobu conditions.

In one aspect, a product of a method of the invention is an (R)-enantiomer, or, an (S)-enantiomer, e.g., in one aspect the ethyl 4-cyano-3-hydroxybutyric acid is an (R)-ethyl 4-cyano-3-hydroxybutyric acid or an (S)-ethyl 4-cyano-3-hydroxybutyric acid.

In one aspect, the (R)-ethyl 4-cyano-3-hydroxybutyric acid product has an enantiomeric purity of between about 80% ee to 99.5% ee, between about 90% ee to 99% ee, or 99% ee, 99.5% ee or higher.

In one aspect, the reaction is a one-pot reaction, or, at least two steps of the reaction take place in sequential pots (a "pot" can be any container or equivalent, e.g., a whole cell, such as a bacterial or a mammalian cell). In one aspect, at least one step of the reaction takes place in a whole cell. The cell can be encapsulated, e.g., in a gel. In one aspect, at least one step of the reaction takes place in a whole cell in a fermentor. In one aspect, at least one step of the reaction takes place in a cell lysate or a whole cell paste. In one aspect, at least one step of the reaction takes place in a membrane reactor, a capillary, or a column. The capillary can comprise a capillary array, e.g., a GIGAMATRIX™.

In one aspect, the methods further comprise converting the 4-cyano-3-hydroxybutyric acid to its potassium salt by reaction with a potassium hydroxide in water, methanol or ethanol. In one aspect, the methods further comprise crystallization of the 4-cyano-3-hydroxybutyric acid potassium salt.

In one aspect, the preparation of hydroxyglutaronitrile from epichlorohydrin is followed by the addition of a neutralizing agent, a buffer or a diluent, and then subsequent conversion to 4-cyano-3-hydroxybutyric acid with the nitrilase. The preparation of hydroxyglutaronitrile from epichlorohydrin, the addition of a neutralizing agent, a buffer or a diluent, and the conversion to 4-cyano-3-hydroxybutyric acid with the nitrilase can take place in a single pot (container), or each step can be in a different pot (container), or, a combination thereof.

In one aspect, at least one step of the reaction takes place under conditions comprising a temperature in a range between about 4° C. and about 80° C., a range between about 10° C. and about 40° C., or a range between about 22° C. and 37° C.

In one aspect, at least one step of the reaction takes place under conditions comprising a pH in a range between about pH 4 and about pH 11, or, in a range between about pH 5 and about pH 9.

In one aspect, substrate concentrations are in the range of between about 5 M, or higher, to 10 mM, or lower.

In one aspect, the nitrilase used in a method of the invention is an isolated or recombinant polypeptide having a sequence at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%,83%, 84%, 85%, 86%, 87%, 88%, 89%, 90%, 91%, 92%, 93%, 94%, 95%, 96%, 97%, 98%, 99%, or more, or complete sequence identity to SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, or enzymatically active subsequences thereof.

In one aspect, the nitrilase comprises a sequence as set forth in SEQ ID NO:196, SEQ ID NO:206, SEQ ID NO:208, SEQ ID NO:210 or SEQ ID NO:238 and having one or more mutations selected from the group consisting of a mutation at residue 55 lysine, residue 55 glycine, residue 55 glutamine, residue 60 glutamic acid, residue 111 serine, residue 190, residue 190 serine, residue 190 histidine, residue 190 tyrosine, residue 190 threonine, residue 191 leucine, residue 191 valine, residue 191 methionine, residue 191 aspartic acid, residue 191 glycine, residue 191 glutamic acid, residue 191 tyrosine, residue 191 threonine, residue 199 glutamic acid, residue 199 leucine, residue 222 leucine, and any combination thereof.

In one aspect, the nitrilase comprises a sequence as set forth in SEQ ID NO:196, SEQ ID NO:206, SEQ ID NO:208, SEQ ID NO:210 or SEQ ID NO:238 and having a mutation at residue 190 or equivalent, wherein alanine is replaced with a hydrogen-binding amino acid or hydrogen-binding peptidomimetic residue.

In one aspect, the nitrilase comprises a sequence as set forth in SEQ ID NO:196, SEQ ID NO:206, SEQ ID NO:208, SEQ ID NO:210 or SEQ ID NO:238 and having a mutation at residue 190 or equivalent, wherein alanine is replaced with a hydrophobic amino acid or hydrophobic peptidomimetic residue.

In one aspect, the nitrilase comprises a sequence having the equivalent of one or more mutations at residue 55 lysine, glycine, or glutamine; at residue 60 glutamic acid; at residue 111 serine, at residue 190, serine, histidine, tyrosine or threonine; at residue 191, leucine, valine, methionine, aspartic acid, glycine, glutamic acid, tyrosine or threonine; at residue 199 glutamic acid or leucine; at residue 222 leucine of SEQ ID NO:196, SEQ ID NO:206, SEQ ID NO:208, SEQ ID NO:210 or SEQ ID NO:238.

In one aspect, the nitrilase is encoded by a nucleic acid having a sequence at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%,76%, 77%, 78%, 79%, 80%, 81%, 82%, 83%, 84%, 85%, 86%, 87%, 88%, 89%, 90%,91%, 92%, 93%, 94%, 95%, 96%, 97%, 98%, 99%, or more, or complete sequence identity to SEQ ID NO:1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383 or 385.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

DESCRIPTION OF DRAWINGS

Like reference symbols in the various drawings indicate like elements.

DETAILED DESCRIPTION

Figure 1:
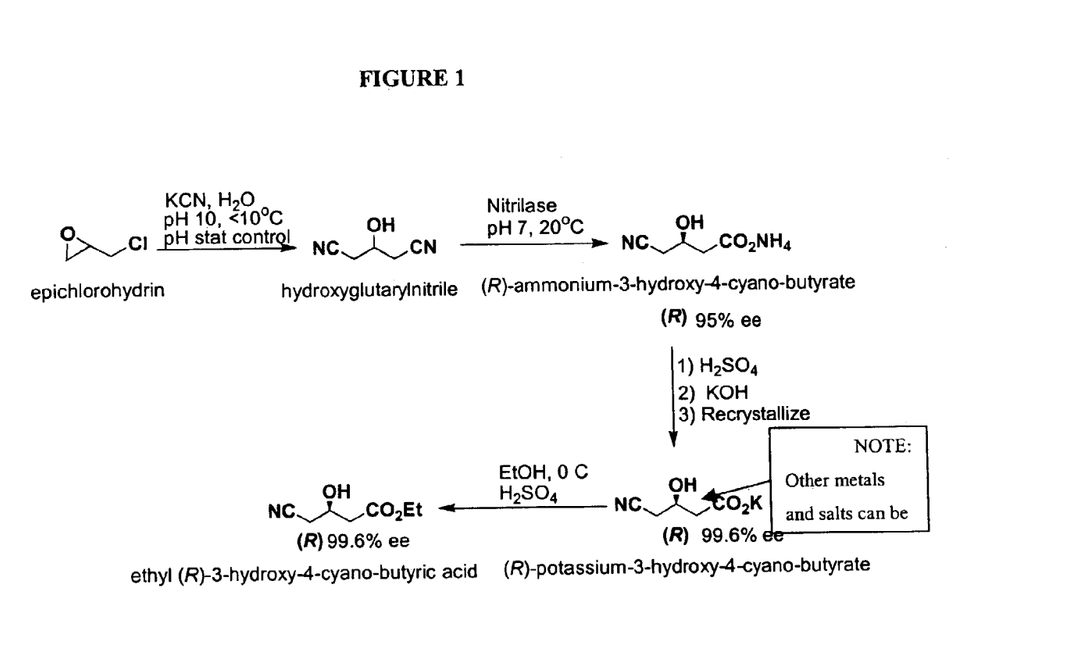
FIG. 1 schematically illustrates an exemplary method of the invention using epichlorohydrin to yield the product (R)-ethyl 4-cyano-3-hydroxybutyric acid.

The methods of the invention use epichlorohydrin, or equivalent, as a starting material to yield the product (R)-ethyl-4-cyano-3-hydroxybutyrate. In one aspect, the product is produced with a chiral purity of more than 99% ee.

In one aspect of the processes of the invention, epichlorohydrin is converted to 3-hydroxyglutaronitrile (HGN) by cyanide treatment under pH and temperature control, with high yield and purity. In one aspect of the processes of the invention, 3-hydroxyglutaronitrile (HGN), whether prepared by this method or another process, whether a crude product (e.g., without isolation) or an isolated pure composition, is converted to 4-cyano-3-hydroxybutyric acid by catalysis with a nitrilase. Any nitrilase can be used.

In one aspect, the processes of the invention produce an enantiomerically pure product, e.g., an (R)-ethyl-4-cyano-3-hydroxybutyrate. In alternative aspects of the process, the product is 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.9% or 100% enantiomerically pure, for example the processes of the invention yielding a product having an enantiomeric excess of between about 85% ee to about 99.5% ee. In one aspect, the chiral product is an (R)-enantiomer. In another aspect, the chiral product is an (S)-enantiomer.

In one aspect, the processes of the invention yield a product having an enantiomeric excess of between about 90% ee to 99% ee. It was demonstrated that this acid product (4-cyano-3-hydroxybutyric acid) can be isolated via precipitation with calcium hydroxide. The precipitate can then be converted into (R)-ethyl-4-cyano-3-hydroxybutyrate by esterification, in a one-pot reaction.

In another aspect, the acid product can be converted to its potassium salt by reaction with potassium hydroxide in water, methanol or ethanol. A process is established whereby crystallization of this potassium salt from ethanol or methanol/MTBE is shown to upgrade the enantiomeric excess of the acid to greater than 99% ee. In one aspect, the process is carried out with and/or without the crystallization step or with and without a $Ca^{2+}$ salt precipitation step.

In another aspect, the methods include the sequential preparation of hydroxyglutaronitrile (HGN) from epichlorohydrin followed by the addition of neutralizing agent, buffer or other diluents and then subsequent transformation with a nitrilase or the direct addition of a nitrilase to the crude reaction of the HGN production.

In another aspect, a 4-cyano-3-hydroxy butyrate ester may be made (in another aspect, in the same pot) through a variety of methods (see below).

In another aspect, sequential pots are used for two or more or all or the different steps of the reaction. In one aspect, crude preparations, or purified materials, or both, are transferred to new vessels.

In one aspect, the nitrilase reaction is applied to purify crude hydroxyglutaronitrile (HGN). In alternative aspects, purification can be by distillation, column chromatography, crystallization (e.g. K+ salt) or precipitation (e.g. $CaCl_2$).

In alternative aspects, various types of crystallizing salts (not only potassium) can be used. Other types of crystallizing salts can be used include sodium, lithium, rubidium, cesium or any other monovalent or divalent metal.

The invention provides several ways of doing esterification, including Fisher esterification (e.g., Fisher-Speier esterification, see, e.g., Srinivas (1990) J. Chromatogr. 530: 327-336), catalyzed by HCl, sulfuric acid, or other acids including acidic resins; or, esterification under Mitsunobu conditions (see, e.g., Ahn (2002) J. Org. Chem. 67:1751-1753; Ahn (2002) J. Org. Chem. 67:1754-1759). The methods of the invention can be practiced with any protocol for the preparation of esters, including under preparation of esters Mitsunobu conditions or any other method known in the art, including transesterification. In alternative aspects, the methods of the invention can be practiced with other esters if possible: methyl, ethyl, propyl, iso-propyl, butyl etc.

In alternative aspects, the invention provides various preparations of tert-butyl esters by treatment of the salt with tert-butyl bromide and the preparation of esters by treatment of carboxylic acid with dehydrating agents (e.g. DCC-dicyclohexylcarbodimide) and an alcohol.

In alternative aspects, processes of the invention can be performed directly in a fermentor with whole cells, with whole cell paste (e.g., wet or dry, immobilized or free), using cell lysates, e.g., crude, semi-processed, unprocessed or clarified lysate, lyophilized or not, or immobilized or free lysate preparations.

The methods of the invention can be practiced with purified or partially purified nitrilase. The nitrilase can be encapsulated within a gel. If whole cells are used, they can be encapsulated within a gel.

In alternative aspects, the processes of the invention can be run in a batch wise process or via pulsed or continuous feeding of substrate in a number of reactor configurations, including a membrane reactor or column.

In alternative aspects, the processes of the invention can be run using temperatures in the range of 2° C., 4° C., 10° C., 15° C., 22° C., 30° C., 37° C., 40° C. (e.g., in a range of between about 4° to about 40° C.), 45° C., 50° C., 55° C., 60° C., 65° C., 75° C., to protect as high as 80° C. or more. The processes of the invention can be run using pH in the range of about 5 to about 9, or, from about pH 4 to about pH 11, at a pH of about 2, 3, 4, 5, 6, 7, 8, 9, 10, 11, 12 or higher, or lower.

In alternative aspects, the processes of the invention can be run using substrate concentrations as high at 5 M and as low as 10 mM, e.g., at a substrate concentration of about 5 mM, 10 mM, 20 mM, 50 mM, 100 mM, 150 mM, 200 mM, 250 mM, 300 mM, 350 mM, 400 mM, 450 mM, 500 mM, 550 mM, 600 mM, 700 mM, 800 mM, 900 mM, 1 M, 1.5 M, 2 M, 2.5 M, 4 M, 3.5 M, 4 M, 4.5 M 5 M, or higher, or lower.

In alternative aspects, the processes of the invention can be run using various ionic strengths and buffer conditions. The process of the invention can be run using no buffer under pH stat conditions or in saline unbuffered.

General Methods

In various aspects, the invention provides processes for making 4-cyano-3-hydroxybutyric acid and ethyl-4-cyano-3-hydroxybutyrate. The invention can be practiced in conjunction with any method or protocol known in the art, which are well described in the scientific and patent literature.

The skilled artisan will recognize that the starting and intermediate compounds used in the methods of the invention can be synthesized using a variety of procedures and methodologies, which are well described in the scientific and patent literature., e.g., Organic Syntheses Collective Volumes, Gilman et al. (Eds) John Wiley & Sons, Inc., NY; Venuti (1989) Pharm Res. 6:867-873. The invention can be practiced in conjunction with any method or protocol known in the art, which are well described in the scientific and patent literature. Enzymes of the invention, and the enzymes used in the methods of the invention, can be produced by any synthetic or recombinant method, or, they may be isolated from a natural source, or, a combination thereof.

The compositions used to practice the invention, including nucleic acids and proteins used to practice the methods of the invention can be detected, confirmed and quantified by any of a number of means well known to those of skill in the art. General methods for detecting reaction products of the methods of the invention, starting products and intermediates, nucleic acids and proteins used to practice the invention, and the like, include analytic biochemical methods such as spectrophotometry, radiography, electrophoresis, capillary electrophoresis, high performance liquid chromatography (HPLC),thin layer chromatography (TLC), hyperdiffusion chromatography, and the like, and various immunological methods such as fluid or gel precipitin reactions, immunodiffusion (single or double), immunoelectrophoresis, radioimmunoassays (RIAs), enzyme-linked immunosorbent assays (ELISAs), immunofluorescent assays, and the like. The detection of nucleic acids can be by well known methods such as Southern analysis, northern analysis, gel electrophoresis, PCR, radiolabeling, scintillation counting, and affinity chromatography.

The discussion of the general methods given herein is intended for illustrative purposes only. Other alternative methods and embodiments will be apparent to those of skill in the art upon review of this disclosure.

Nitrilases

In one aspect of the processes of the invention, 3-hydroxyglutaronitrile (HGN) is transformed into 4-cyano-3-hydroxybutyric acid catalyzed by a nitrilase. Any nitrilase can be used to practice the invention. Nitrilases are capable of converting nitrites directly to carboxylic acids. Nitrilase enzymes used to practice the methods of the invention are found in a wide range of mesophilic micro-organisms, including species of *Bacillus, Norcardia, Bacteridium, Rhodococcus, Micrococcus, Brevibacterium, Alcaligenes, Acinetobacter, Corynebacterium, Fusarium* and *Klebsiella*. Additionally, nitrilase enzymes used to practice the methods of the invention include isolated and recombinant thermophilic nitrilases, some of which can be derived from bacteria.

In one aspect, a nitrilase used in a method of the invention is an isolated or recombinant polypeptide encoded by a nucleic acid having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%,81%, 82%, 83%, 84%, 85%, 86%, 87%, 88%, 89%, 90%, 91%, 92%, 93%, 94%, 95%, 96%, 97%, 98%, 99%, or more, or complete sequence identity (100% identical) to SEQ ID NO:1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, or variants or subsequences thereof.

In one aspect, a nitrilase used in a method of the invention is an isolated or recombinant polypeptide having a sequence at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete sequence identity (100% identical) to SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, or variants thereof, or active subsequences thereof.

Exemplary nitrilase variants that can be used in the methods of the invention may include, for example, the following variations of SEQ ID NO:195, 205, 207, 209, or 237, having one or more mutations: at positions 163-165 AAA, AAG, GGT, GGC, GGA, GGG, CAA, or CAG; at positions 178-180 GAA or GAG; at positions 331-333 TCT, TCC, TCA, TCG, AGT, or AGC; at positions 568-570 CAT, CAC, TCT, TCC, TCA, TCG, AGT, AGC, ACT, ACC, ACA, TCA, TAT, TAC, ATG or ACG; at positions 571-573 TTA, TTG, CTT, CTC, CTA, CTG, GTT, GTC, GTA, GTG, ATG, ACT, ACC, ACA, GAT, GAC, GGT, GGC, GGA, GGG, GAA, GAG, TAT, TAC, or ACG; at positions 595-597 GAA, GAG, TTA, TTG, CTT, CTC, CTA, or CTG; at positions 664-666 TTA, TTG, CTT, CTC, CTA, or CTG; or any combination thereof.

Exemplary nitrilase variants that can be used in the methods of the invention may also include the following variations of SEQ ID NO:196, 206, 208, 210 or 238, having one or more mutations: at residue 55 lysine, glycine, or glutamine; at residue 60 glutamic acid; at residue 111 serine, at residue 190, serine, histidine, tyrosine or threonine; at residue 191, leucine, valine, methionine, aspartic acid, glycine, glutamic acid, tyrosine or threonine; at residue 199 glutamic acid or leucine; at residue 222 leucine; or any combination thereof.

Exemplary nitrilases that can be used in the methods of the invention may also include fragments of an enzyme, e.g., as described herein. In one aspect, the nitrilase used in the methods of the invention can be at least 20, 20, 40, 50, 60, 70, 80, 90 or 100 or more amino acids in length. Exemplary nitrilases that can be used in the methods of the invention may also include peptidomimetics having nitrilase activity. The nitrilases that can be used in the methods of the invention can be codon-optimized polypeptides or fragments thereof, wherein the codon usage is optimized for a particular organism or cell or lysate.

In one aspect of the invention, the invention uses nitrilase variants having improved or diminished enantioselectivity, for example, in the conversion of a 3-hydroxyglutarylnitrile (HGN) to (R)-4-cyano-3-hydroxybutyrate, than one of the exemplary polypeptides noted herein.

Immobilized Polypeptide Solid Supports

The polypeptides having a nitrilase activity, e.g., enzymes, catalytic antibodies and fragments thereof, can be affixed to a solid support. In one aspect, a mixture of enzymes or active fragments thereof used for various steps in a process of the invention are attached to a solid support. In one aspect, they can be immersed into a reaction pot, a lysate, a process vat, and the like. The solid support can be taken out of the pot, vat, etc. along with the enzymes affixed thereto, for repeated use. In one aspect of the invention, the solid support is a capillary, a gel, a resin, a polymer, a ceramic, a glass, a quartz, a microelectrode and any combination thereof. High throughput apparatus can be adapted and used to practice the methods of the invention, see, e.g., U.S. patent application No. 20020001809.

For example, solid supports useful in the methods of the invention include gels. Some examples of gels include Sepharose, gelatin, glutaraldehyde, chitosan-treated glutaraldehyde, albumin-glutaraldehyde, chitosan-Xanthan, toyopearl gel (polymer gel), alginate, alginate-polylysine, carrageenan, agarose, glyoxyl agarose, magnetic agarose, dextran-agarose, poly(Carbamoyl Sulfonate)hydrogel, BSA-PEG hydrogel, phosphorylated polyvinyl alcohol (PVA), monoaminoethyl-N-aminoethyl (MANA), amino, or any combination thereof.

Another solid support useful in the present invention are resins or polymers. Some examples of resins or polymers include cellulose, acrylamide, nylon, rayon, polyester, anion-exchange resin, AMBERLITE™ XAD-7, AMBERLITE™ XAD-8, AMBERLITE™ IRA-94, AMBERLITE™ IRC-50, polyvinyl, polyacrylic, polymethacrylate, or any combination thereof.

Another type of solid support useful in the present invention is ceramic. Some examples include non-porous ceramic, porous ceramic, $SiO_2$, $Al_2O_3$. Another type of solid support useful in the present invention is glass. Some examples include non-porous glass, porous glass, aminopropyl glass or any combination thereof. Another type of solid support that can be used is a microelectrode. An example is a polyethyleneimine-coated magnetite. Graphitic particles can be used as a solid support. Another example of a solid support is a cell, such as a red blood cell.

Methods of Immobilization

There are many methods that would be known to one of skill in the art for immobilizing antibodies, enzymes or fragments thereof, or reagents or catalysts, onto a solid support. Some examples of such methods include, e.g., electrostatic droplet generation, electrochemical means, via adsorption, via covalent binding, via cross-linking, via a chemical reaction or process, via encapsulation, via entrapment, via calcium alginate, or via poly(2-hydroxyethyl methacrylate). Like methods are described in Methods in Enzymology, Immobilized Enzymes and Cells, Part C. 1987. Academic Press. Edited by S. P. Colowick and N. O. Kaplan. Volume 136; and Immobilization of Enzymes and Cells. 1997. Humana Press. Ed. G. F. Bickerstaff. Series: Methods in Biotechnology, Ed. J. M. Walker.

Arrays

Reagents, catalysts and polypeptides (e.g., nitrilases) and the like used to practice the invention can be immobilized by application to an array. Capillary arrays, such as the GIGAMATRIX™, Diversa Corporation, San Diego, Calif.; and arrays described in, e.g., U.S. patent application No. 20020080350 A1; WO 0231203 A; WO 0244336 A, provide an alternative apparatus for practicing the invention.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent application Nos. 20010018642; 20010019827; 20010016322; 20010014449; 20010014448; 20010012537; 20010008765.

Antibodies and Antibody-Based Screening Methods

Isolated or recombinant antibodies are used to practice the invention, e.g., catalytic antibodies having a nitrilase activity can be used in the processes of the invention. Alternatively, antibodies can be used to isolate, identify or quantify the nitrilases or related polypeptides used to practice the methods of the invention.

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, N.Y. (1991); Stites (eds.) BASIC AND CLINICAL IMMUNOLOGY (7th ed.) Lange Medical Publications, Los Altos, Calif.; Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

Whole Cell Engineering and Measuring Metabolic Parameters

The methods of the invention can be practiced in whole or in part in a whole cell environment. The invention also provides for whole cell evolution, or whole cell engineering, of a cell to develop a new cell strain having a new phenotype to be used in the methods of the invention, e.g., a new cell line comprising one, several or all enzymes needed to practice a method of the invention. This can be done by modifying the genetic composition of the cell, where the genetic composition is modified by addition to the cell of a nucleic acid, e.g., a coding sequence for an enzyme used in the methods of the invention. See, e.g., WO0229032; WO0196551.

The host cell for the "whole-cell process" may be any cell known to one skilled in the art, including prokaryotic cells, eukaryotic cells, such as bacterial cells, fungal cells, yeast cells, mammalian cells, insect cells, or plant cells.

To detect the production of an intermediate or product of the methods of the invention, or a new phenotype, at least one metabolic parameter of a cell (or a genetically modified cell) can be monitored in the cell in a "real time" or "on-line" time frame by Metabolic Flux Analysis (MFA). In one aspect, a plurality of cells, such as a cell culture, is monitored in "real time" or "on-line." In one aspect, a plurality of metabolic parameters is monitored in "real time" or "on-line."

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:
  identity of all pathway substrates, products and intermediary metabolites
  identity of all the chemical reactions interconverting the pathway metabolites, the stoichiometry of the pathway reactions,
  identity of all the enzymes catalyzing the reactions, the enzyme reaction kinetics,
  the regulatory interactions between pathway components, e.g. allosteric interactions, enzyme-enzyme interactions etc,
  intracellular compartmentalization of enzymes or any other supramolecular organization of the enzymes, and,
  the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization.

Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc. Any aspect of metabolism or growth can be monitored.

Generating and Manipulating Nucleic Acids

In one aspect, the nitrilase used to practice the methods of the invention is an isolated or a recombinantly generated nitrilase. In one aspect, the nitrilase used to practice the methods of the invention is encoded by a nucleic acid having a sequence at least about 50%, 51%, 52%, 53%, 54%, 55%, 56%, 57%, 58%, 59%, 60%, 61%,62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete identity (100% identical) to SEQ ID NO:1, 3, 5, 7, 9, 11, 13, 15, 17, 19, 21, 23, 25, 27, 29, 31, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383 and/or 385, or fragments thereof.

In one aspect, the percent identity between two given sequences (nucleic acid or polypeptide) can be calculated using an algorithm such as BLAST (Altschul (1990) J. Mol. Biol. 215:403-410). When using the BLAST algorithm for sequences no longer than 250 nucleotides or about 80 amino acids ("short queries"), the search parameters can be as follows: the filter is off, the scoring matrix is PAM30, the word size is 3 or 2, the E value is 1000 or more, and the gap costs are 11, 1. For sequences longer than 250 nucleotides or 80 amino acid residues, the default search parameters can be used.

Nucleic acids encoding enzymes used to practice the methods of the invention, whether RNA, cDNA, genomic DNA, vectors, viruses or hybrids thereof, may be isolated from a variety of sources, genetically engineered, amplified, and/or expressed/generated recombinantly. Recombinant polypeptides generated from these nucleic acids can be individually isolated or cloned and tested for a desired activity. Any recombinant expression system can be used, including bacterial, mammalian, yeast, insect or plant cell expression systems. Nucleic acids used to practice the methods of the invention, and to make the polynucleotides and polypeptide of the invention, can be generated using amplification methods, which are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario).

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440 3444; Frenkel (1995) Free Radic. Biol. Med. 19:373 380; Blommers (1994) Biochemistry 33:7886 7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993). Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

The invention will be further described with reference to the following examples; however, it is to be understood that the invention is not limited to such examples.

EXAMPLES

Example 1

Materials: 3-hydroxyglutaronitrile was purchased from TCI America. (R)-3-hydroxy-4-cyanobutyric acid was obtained from Gateway Chemical Technology (St. Louis, Mo.). All other reagents were purchased from Sigma Aldrich and utilized without further purification. Silica Gel, 70-230 mesh, 60 Å, purchased from Aldrich, was used for chromatographic purifications.

I. (a) Preparation of 3-hydroxy-glutaronitrile (HGN)

KCN (1.13 mol, 61.7 g) was dissolved in water (160 ml) at 20° C. The pH of the solution was adjusted to and maintained at pH 10.0 by addition of 6 M HCl acid via an automated burette and below 10° C. by cooling in an ice bath. Epichlorohydrin (0.60 mol, 55.5 g) was added dropwise while the temperature was maintained below 10° C. The reaction was allowed to proceed at 10° C. until the pH of the solution begins to drop below 10. At this point the pH was maintained at 10.0 by the addition on 6N KOH via pH stat and the reaction was allowed to proceed overnight with stirring at 20° C. The solution was then adjusted to pH7 by addition of 6 N HCl and then continuously extracted with EtOAc (400 ml) for 48 h. The organic extract was dried over $Na_2SO_4$ and then concentrated in vacuo. Crude 3-glutaronitrile was obtained in 85% yield as a deep red liquid (57 g, 0.52 mol). The product was purified by vacuum distillation to obtain hydroxyglutarol nitrile as a clear yellow liquid in 59% yield (0.35 mol, 39 g) $^1$H NMR ($D_2O$): 4.40 (m, 1H), 2.89 (m, 4H). $^{13}$C NMR ($D_2O$): 117.3, 61.91, 23.69. MS calc'd for [$C_5H_6N_2O$]: 110.05, found: 110.00 [M$^+$], (ESI+).

II. a) Hydrolysis of 3-hydroxy-glutaronitrile (Purified) With Nitrilase 3-hydroxyglutaronitrile (1 g, 9 mmol) was suspended in 37.5 mL of $N_2$ (g) sparged, room temperature, 100 mM sodium phosphate buffer at pH 7. To this 240 mM solution of HGN was added 150 mg of cell lysate normalized for protein content. As assessed by PAGE, the nitrilase content was established to be 20% of the total protein. Therefore effectively, 30 mg of nitrilase is used in this reaction. The reaction was agitated at 100 rpm. Reaction progress was monitored by TLC (1:1 EtOAc:Hexanes, $R_f$=0.32, nitrile; $R_f$=0.0, acid) and GC. After 22 h, the reaction was filtered through a 10,000 MW cutoff filter and then concentrated in vacuo. The concentrated hydrolysis solution was acidified with 1M HCl and the product was continuously extracted with MTBE (30 mL). The acid product (R)-3-hydroxy-4-cyanobutyric acid was isolated as a yellow oil (1.15 g, 98% yield). $^1$H NMR ($d_6$-DMSO, 500 MHz) δ12.32 (s, 1H), 5.52 (s, 1H), 4.10 (m, 1H), 2.70 (dd, 1H, J=16.8, 4.1 Hz), 2.61 (dd, 1H, J=16.9, 6.3 Hz), 2.44 (dd, 1H, J=15.4, 5.3 Hz), 2.37 (dd, 1H, J=15.6, 7.8 Hz). $^{13}$C NMR (DMSO, 298K, 125 MHz) δ171.9, 118.7, 63.4, 41.2, 25.2 MS calc'd for [$C_5H_7NO_3$]: 129.0, found: 130.0 [M+H$^+$], (ESI+). ee=95% [HPLC]. Based on the isolated yield a productivity of 40 g g$^{-1}$ d$^{-1}$ is calculated.

b) Integrated Process for Preparation of HGN, Hydrolysis of 3-hydroxy-glutaronitrile (Crude) with Nitrilase, Ca(OH)$_2$ Precipitation and Esterification KCN (1.13 mol, 61.7 g) was dissolved in water (160 ml) at 20° C. The pH of the solution was adjusted to and maintained at pH 10.0 by addition of 6 M HCL acid via an automated burette and below 10° C. by cooling in an ice bath. Epichlorohydrin (0.60 mol, 55.5 g) was added dropwise while the temperature was maintained below 10° C. The reaction was allowed to proceed at 10° C. until the pH of the solution begins to drop below 10. At this point the pH was maintained at 10.0 by the addition on 6N KOH via pH stat and the reaction was allowed to proceed overnight with stirring at 20° C. The solution was then adjusted to pH7 by addition of 6 N HCl. The final concentration of HGN in this reaction was assessed to be 1.24 M A portion of this crude solution of HGN (7.4 mL) was diluted with 33.6 mL pH 7 100 mM phosphate. To this solution was added 100 mg of cell lysate, normalized for protein content, which had been suspended in 5 mL 100 mM phosphate buffer. The reaction mixture contained 9.25 mmol HGN in 46 mL buffer at a final concentration of 200 mM As assessed by PAGE, the nitrilase content was established to be 20% of the total protein. Therefore effectively, 20 mg of nitrilase is used in this reaction. The reaction was agitated at room temperature at 100 rpm. Reaction progress was monitored by TLC (1:1 EtOAc:Hexanes, $R_f$=0.32, nitrile; $R_f$=0.0, acid) After all the HGN was consumed (22 hours), the reaction solution was filtered through celite.

The filtered solution was cooled in an ice-water bath and then 3 g calcium hydroxide monohydrate was added to it. Ethanol (85 mL) was added to the above suspension and after stirring for 1 hour the resulting white solid was filtered, washed with ethanol and dried in vacuo overnight. The calcium salt was isolated as a white solid (4.6 g). This material was suspended in 50 ml of 200 proof ethanol, cooled by an ice-water-salt bath, and then 1 ml concentrated sulfuric acid was added dropwise. Once acidified the solution was subjected to reflux for one hour. After cooling the solid impurities were removed by filtration and the filtrate was concentrated in vacuo. Pure (R)-ethyl 4-cyano-3-hydroxybutyrate (1.1 g, 79% yield based on epichlorohydrin, 93% ee) was isolated as a pale yellow oil by Kugelrohr distillation.

(c) Crystallization of Potassium 4-cyano-3-hydroxybutyrate

Method one: To a 1 g of 4-cyano-3-hydroxybutyric acid in 10 mL water, chilled on an ice bath, was added a concentrated solution of KOH (20% w/v, 1.05 equivalents). This solution was concentrated to dryness in vacuo and then the residue was recrystallized from hot ethanol. White needle crystals were formed and resulted in an enantiomeric excess enhancement from 93% ee to 97% ee with up to 80% recovery achieved to date. This was performed several times on one gram scale and once at a 10 g scale.

Method Two: To a 1 g of 4-cyano-3-hydroxybutyric acid in 15 mL methanol was added a concentrated methanolic solution of KOH (20% w/v, 1.05 equivalents). To this solution was added MTBE to initiate crystallization. This procedure yielded an enantiomeric excess enhancement from 94% ee to 98% ee with 88% yield achieved to date. A second recrystallization afforded an enrichment from 98% ee to 99.6% ee (80% yield). In addition, in a single crystallization 95.5% ee samples were enriched to 99.2% (20% yield on first attempt). The crystallization methods have not been optimized. This was performed several times on a one gram scale.

III (a) Synthesis of (R)-Ethyl 4-cyano-3-hydroxybutyric With HCl Catalyst

A 0.2 M solution of (R)-3-hydroxy-4-cyanobutyric acid (50 mg, 0.4 mmol) in anhydrous ethanol (1.94 mL) was prepared. The ethanol solution was added dropwise to 1.0 ml of a 50:50 (v/v) mixture of anhydrous 1 M HCl ethereal solution and anhydrous ethanol over molecular sieves. The reaction was stirred overnight at room temperature under $N_2$. The reaction was monitored by TLC, (1:1 EtOAc:Hexanes, $R_f$=0.45, ester; $R_f$=0.0, acid, stained with p-anisaldehyde). After 30 h, solvent was removed in vacuo. The crude product was taken up in $Et_2O$ (25 mL), washed with 5 ml saturated bicarbonate and then 5 mL brine. The organic extract was dried over $MgSO_4$, filtered and then concentrated in vacuo, yielding the product as a clear oil. $^1H$ NMR (DMSO, 298K, 500 MHz) δ5.60 (d, 1H, J=5.58 Hz), 4.12 (m, 1H), 4.07 (q, 2H, J=7.1), 2.66 (m, 2H), 2.47 (m, 2H), 1.87 (t, 3H, J=7.0). $^{13}C$ NMR (DMSO, 298K, 125 MHz) δ170.21, 118.60, 63.40, 59.98, 41.10, 25.14, 14.02. MS calc'd for $[C_7H_{11}NO_3]$: 157.1, found 158.2. [M+H$^+$]

(b) Synthesis of (±)-Ethyl 4-cyano-3-hydroxybutyrate With $H_2SO_4$ Catalyst A 1 M solution of 4-cyano-3-hydroxybutyric acid in anhydrous ethanol was prepared and cooled in an ice bath. Several drops of concentrated sulfuric acid was added. The reaction mixture was then subjected to reflux for 4 hours to overnight. After reaction, the solvent was removed in vacuo. Ethyl ester formation was found to be quantitative.

Analytical Information

All $^1H$ and $^{13}C$ NMR spectra were run on Bruker model AM-500 instruments, set at room temperature, 500 MHz and 125 MHz respectively for $^1H$ and $^{13}C$. GC analysis was performed on an Agilent 6890 GC with a Macherey-Nagel Lipodex A column, using a FID detector. The HPLC analysis was performed on an Agilent 1100 HPLC with a Daicel OD column (50×0.46 cm) and the DAD detector set at 210, 220, and 250 nm. Specific rotation was determined on a Perkin Elmer Model 341 Polarimeter, set at 589 nm, Na lamp, at room temperature, with a 100 mm path length cell. Concentrations (c) for specific rotation are reported in grams per 100 ml of solvent.

| | Analytical Methods: | | | |
|---|---|---|---|---|
| | Acid Product | Column | Chromatography Method Details | Retention Times Of enantiomers (min) |
| HPLC | 4-cyano-3-hydroxybutyrate | Daicel OD 50 × 4.6 mm | 5% isopropanol, 95% hexane 1 ml/min | 4.5 (R); 5.4 (S) |
| GC | Methyl 4-cyano-3-hydroxybutyrate | Lipodex A 25 m Macherey-Nagel | 95° C., 1 ml/min | 51.6 (R); 52.7 (S) |

Preparation of (R)-(−)-Methyl 4-cyano-3-hydroxybutyrate (R)-4-cyano-3-hydroxybutyric acid (658 mg, 5.1 mmol) was dissolved in methanol (20 ml) and the solution was treated with dropwise addition of TMS-diazomethane (2 M solution in hexane, 150 mmol) at 22° C. for 1 hr to yield the methyl ester product. The mixture was concentrated in vacuo, extracted with ethyl acetate (3×40 ml) and then the combined organic extracts were dried over $MgSO_4$, filtered and concentrated in vacuo giving a yellow oil (549 mg, 3.84 mmol, 74% yield). $^1H$ NMR (DMSO, 298K, 500 MHz) δ5.60 (d, 1H, J=5.26 Hz), 4.13 (m, 1H), 3.60 (s 3H), 2.71 (dd, 1H, J=16.9, 4.2 Hz,), 2.63 (dd, 1H, J=16.9, 6.7), 2.54 (dd, 1H, J=14.9, 4.9), 2.44 (dd, 1H, J=15.7, 7.9) $^{13}C$ NMR (DMSO, 298K, 125 MHz) 170.7, 118.6, 63.4, 51.4, 40.9, 25.1, Exact Mass Calculated for $[C_6H_9NO_3]$: 143.1, found: 144.0 [M+H$^+$].

Benzoyl chloride (0.068 ml, 0.75 mmol) was added to a stirred solution of (R)-methyl 4-cyano-3-hydroxybutyrate (72 mg, 0.5 mmol) in pyridine (2 ml), at room temperature. After 19 hours, an additional 0.5 equivalent of benzoyl chloride (0.023 ml, 0.25 mmol) was added. After 24 h, 1 ml water was added to the reaction mixture that was then extracted with diethyl ether (3×10 ml). The combined organic extracts were washed with brine (2×10 ml), dried over $MgSO_4$, filtered and concentrated in vacuo. The crude product was purified by silica gel flash chromatography (eluant hexane:ethyl acetate [2:1]) yielding a yellow oil (46 mg, 0.19 mmol, 37%). $^1H$ NMR (DMSO, 298K, 500 MHz) d 7.96 (d, 2H, J=7.8), 7.70 (t, 1H, J=7.25), 7.56 (t, 2H, J=7.8), 5.55 (m, 1H), 3.59 (s, 3H), 3.13 (m, 2H), 2.90 (m, 2H). $^{13}C$ NMR (DMSO, 298K, 125 MHz) d 169.6, 164.5, 133.8, 129.3, 128.9, 128.5, 117.3, 66.0, 51.8, 37.5, 22.2 MS calc'd for $[C_{13}H_{13}NO_4]$: 247.25, found: 270.3 [M+Na$^+$] ee=95% [HPLC]. $[\alpha]^{20}_{598}$ −32.4 (c=0.5, CHCl$_3$).

Example 2

The following is an exemplary protocol for making (R)-ethyl 4-cyano-3-hydroxybutyric acid by a "one pot process" and a "multi-pot" process. Other exemplary variations to the methods of the invention are also described, including those that can be practiced in processes of the invention other than the exemplary "one pot" or a "multipot" process described herein.

1) This method includes the sequential preparation of HGN (3-hydroxyglutaronitrile) from epichlorohydrin followed by the addition of neutralizing agent, buffer or other diluents and then subsequent transformation with a nitrilase or the direct addition of a nitrilase to the crude reaction of the HGN production. In addition, an ester of 4-cyano-3-hydroxy butyrate may be made in the same pot through a variety of methods (see step 5, below).

Sequential pots can also be used where the crude of purified materials are transferred to new vessels.

2) In one aspect, the process is carried out with and/or without the crystallization step or with and without the Ca salt precipitation step.

3) In one aspect, the nitrilase reaction is applied to purify crude HGN.

Purification can be by distillation, column chromatography, crystallization (e.g. K+ salt) or precipitation (e.g. CaCl2), or any method known in the art.

4) Various types of crystallizing salts (not only potassium) can be used. Other types of crystallizing salts can be used include sodium, lithium, rubidium, cesium or any other monovalent or divalent metal.

5) The invention provides several ways of performing esterification, include Fisher esterification, catalyzed by HCl, sulfuric acid, or other acids including acidic resins.

The invention also provides for preparation of tert-butyl esters by treatment with tert-butyl ethers of the salt with tert-butyl bromide and the preparation of esters by treatment of carboxylic acid with dehydrating agents (e.g. DCC-dicyclohexylcarbodimide) and an alcohol. The methods of the invention can be practiced with any protocol for the preparation of esters, including Mitsunobu conditions or any other method known in the art, including trans-esterification.

6) The methods of the invention can be practiced with other esters if possible: Methyl, ethyl, propyl, iso-propyl, butyl etc.

7) Process can be performed in directly in a fermentor with cell, with whole cell paste (e.g., wet or dry, immobilized or free), using cell lysates (e.g., crude or clarified, lyophilized or not, immobilized or free).

The methods of the invention can be practiced with purified or partially purified nitrilase. Nitrilase (cells etc) can be encapsulated within a gel.

8) The process of the invention can be run in a batch wise process or via pulsed or continuous feeding of substrate in a number of reactor configurations, including a membrane reactor or column.

9) The process of the invention can be run using temperatures in the range of 1° C., 2° C., 4° C., 10° C., 20° C., 22° C., 30° C., 37° C., 40° C., 50° C., 60° C., 70° C., 80° C., 90° C., 95° C., 99° C. (i.e. anywhere in the range of between about 1°-99° C.).

10) The process of the invention can be run using pH in the range of about 5 to about 9, or, from about pH 4 to about pH 11.

11) The process of the invention can be run using substrate concentrations as high at 5 M and as low as 10 mM.

12) The process of the invention can be run using various ionic strengths and buffer conditions. The process of the invention can be run using no buffer under pH stat conditions or in unbuffered saline.

A number of embodiments of the invention have been described. Nevertheless, it will be understood that various modifications may be made without departing from the spirit and scope of the invention. Accordingly, other embodiments are within the scope of the following claims.

SEQUENCE LISTING (386 sequences)

SEQ ID NO: 1 - DNA, 939 bp, Unknown
  Obtained from an environmental sample
atggaaaagtatattaaagtcgccgcaattcagatagctacaaaaatagcagattcacccgtgaatatagaaaattgcgaacgtttggcattatcggcggtcaatgagggtgcgcgttggattgctttgccggagttcttcaatacgggcgttagttggaacaaaaaaattgccttggctattcagacgcctgacggcaaggctgcgatgttcttacgcgacttttctgcaagacatcatgtattgataggaggctcatttctgtgcaggttgccggatggcagtgtgcgcaaccgctatatgtgttatgccaacggcgctctcgtgggcaaacatgacaaagacctacccacgatgtgggaaaatgctttttatgaaggtggggattccagcgatattggggtgctgggaacatttgaaaatacgcgcgttggtgcagccgtctgttgggagttcatgcggacgatgactgcccggcgtcttcgcaatcaggtggatgtcatcatgggtggttcctgctggtggagcataccgaccaatttccccggttttgtgcaaaagctgtgggaacctggaaatagccgcaacgcgcttgctgccatacaggataatgcgcgtctcattggcgtgccggttgttcatgccgctcattgcggtgaaattgagtgtccgatgccaggattgccgataggttacagggggttctttgagggtaacgcggccattgtgaatgcagaaggtcaggtgcttgcgcatcggggtgctggcgagggcgaaggaattgtttgcgcggagattttaccggtagccaaatcaaacaggtcggaaattcccaatcgttactggttgcgctgcagaggctttctacctatttttgcctggcatcagcaacgttggttgggaaggcattggtatttgcgcaatgtgcgcaggacttaa

SEQ ID NO: 2 - protein, 312 aa, Unknown
  Obtained from an environmental sample
MEKYIKVAAIQIATKIADSPVNIENCERLALSAVNEGARWIALPEFFNTGVSWNKKIALAIQTPDGKAAMFLRDFSARHHVLIGGSFLCRLPDGSVRNRYMCYANGALVGKHDKDLPTMWENAFYEGGDSSDIGVLGTFENTRVGAAVCWEFMRTMTARRLRNQVDVIMGGSCWWSIPTNFPGFVQKLWEPGNSRNALAAIQDNARLIGVPVVHAAHCGEIECPMPGLPIGYRGFFEGNAAIVNAEGQVLAHRGAGEGEGIVCAEILPVAKSNRSEIPNRYWLRCRGFLPIFAWHQQRWLGRHWYLRNVRRT

SEQ ID NO: 3 - DNA, 981 bp, Unknown
  Obtained from an environmental sample
atggggaattcgttcaagatcgcggtggtacaagcctgtccggtctttctggatcgtggcgcgacagtcgccaaggcatgccgcctgatcgcggaggcagccgcggcgggcgccagcctggtggtctttccggaggcgtttgtgcccggatacccactgtgggtctggttcattccggcagggcattcgcaaccactgcgggagttatacgccgaactggtggggaacgccgtggcggtaccgggcgatgccaccgatcggctttgcgcggcagccagagaagccggcgtggtagtggcgatcggcatcaatgaagtgaacagcgaagccagcggcacgacgatttacaatacgctgctgtacatcggagcggacggcgcgattctgggcaaacaccgcaaagtaatgccgacgggcggagagcgcctggtctgggcgcttggcgatgggagcgacctggaggtctacgacctgcctttcggccgattgggtggcctgttgtgctgggagaactacatgcccctggcccggtacgcgatgtcggcatggggaaccgagatctacgtggctccaacttgggatcgcggagaaccgtggctgtccacaatgcggcatatcgcgaaagaagggcgatgctacgtagtgggatgctgcagttgcatgaaaattgacgatgtacccgaccggctggcgttcaaagggaagtatctgtcgacggccgagggctggctcaaccccggcgatagcgtaatcgtcgatccggacggcaagctgatcgcgggcccggcaagcgagcaggagacgattctgtatgccgatgccgaccggtctaagatcaccgggcccaggtggcagttggatgtggccggccactacgcgcggccggatatcttcgaactgatcgtgcaccgcgaacctaagcgatttttgacgatagctccgcggacgaaggaggagcgggagcctgggccggaggcctga

SEQ ID NO: 4 - protein, 326 aa, Unknown
  Obtained from an environmental sample
MGNSFKIAVVQACPVFLDRGATVAKACRLIAEAAAAGASLVVFPEAFVPGYPLWVWFIPAGHSQPLRELYAELVGNAVAVPGDATDRLCAAAREAGVVVAIGINEVNSEASGTTIYNTLLYIGADGAILGKHRKVMPTGGERLVWALGDGSDLEVYDLPFGRLGGLLCWENYMPLARYAMSAWGTEIYVAPTWDRGEPWLSTMRHIAKEGRCYVVGCCSCMKIDDVPDRLAFKGKYLSTAEGWLNPGDSVIVDPDGKLIAGPASEQETILYADADRSKITGPRWQLDVAGHYARPDIFELIVHREPKRFLTIAPRTKEEREPGPEA

SEQ ID NO: 5 - DNA, 1005 bp, Unknown
  Obtained from an environmental sample
atgggtaccaagcacccggccttcaaggccgcagtggtccaggccgcgccggaatggctcgatctcgaccgcaccgtcgacaagaccatcgcgctgatcgaggaggccgccggcgccggcgcgaagctcattgcgttcccggaaacctggattcccggctatccgtggcacatctgggtcggcacgccggcgtgggcgatcagccgcggcttcgtgcagcgctacttcgacaattcactggcctacgacagcccgcaggcccagcgcatcgcggacgccgcgaagaagaacaagatcaccgtggtgctcggcctgtcggagcgcgagggtggcagcctttatatctcgcagtggctgattgggccggacggcgagaccattgccaagcgccgcaaactgcgccccacccacgtcgagcgcaccgtgttcggcgatggcgacggcagccacatcgcggtgcacgagcgtgctgacatcggccgcctcggcgcgctgtgctgctgggagcacatccagccgctgaccaaatacgccatgtatgcccagaacgagcaggtgcacgtcgccgcctggccgagcttctcgatgtacgagccgttcgcccacgcgctcggctgggaagtcaacaatgcggcgagcaagatctacgccgtcgaaggctcgtgtttcgtgctcggcgcatgcgcggtgatctcgcaggcgatggtcgacgaaatgtgcgacaccgaggacaagcgggcgctggtccatgccggcggcggccacgcggtgatcttcgggccggacggcagatcgctggcggacaagattccggagacccaggaaggcctgctctatgccgacatcgacctcggcgcaattggcgtggccaagaacgcggccgatccggcggggcactactcgcgcccggacgtgacgcggctcctgttcaacaacaagccggcgcgccgggtcgagtatttctcgctgccggtcgacgcggtcgagacgccgccgcagccctga

SEQ ID NO: 6 - protein, 334 aa, Unknown
  Obtained from an environmental sample
MGTKHPAFKAAVVQAAPEWLDLDRTVDKTIALIEEAAGAGAKLIAFPETWIPGYPWHIWVGTPAWAISRGFVQRYFDNSLAYDSPQAQRIADAAKKNKITVVLGLSEREGGSLYISQWLIGPDGETIAKRRKLRPTHVERTVFGDGDGSHIAVHERADIGRLGALCCWEHIQPLTKYAMYAQNEQVHVAAWPSFSMYEPFAHALGWEVNNAASKIYAVEGSCFVLGACAVISQAMVDEMCDTEDKRALVHAGGGHAVIFGPDGRSLADKIPETQEGLLYADIDLGAIGVAKNAADPAGHYSRPDVTRLLFNNKPARRVEYFSLPVDAVETPPQP

SEQ ID NO: 7 - DNA, 999 bp, Unknown
  Obtained from an environmental sample
atgccgagtgattatcatgctccattcaaagtagcagttgtccaggcaactcccgtctttctcgatcgcagcgcgacgattgagaaggcatgtgagctaattgcctgtgctggacgtgagggcgcacgtctgatcgtgtttcctgaagcgttcattcccacctatcccgattgggtctggaccattccacctggggagatgcggctgcttggcgaactctacacagagttgcttgccaatgcggtcacgatccccagtaatgcaacggataggctctgccaggctgcgaaacgagctgctgcgtatgtggtcatgggaatgaacgaacgcaatatcgaggcgagtggaaggagtctctataacaccctgttatacatcgatgctcagggccagatcatgggcaaacaccgcaagttgatacccacagccggtgagcggctcatatgggcgcaaggagatgggagtacattccaggtctacgatactcctctgggcaaactgggagggctcatctgctgggaaaactacatgcctctggctcgctatgcgatgtatgcctggggcacgcagatttatgtcgccccgacatgggatcgtggcaacctctggctctctactctgcggcatatcgctaaggagggaggcgtctatgttcttggttgtagtatggtcatgcgcaagaatgacattcccgatcactttgctttcaaagagcagttttatgctactgtggacgaatggatcaacgttggtgacagcgccattgtccatcccgaggggaactttcttgcgggaccggtgcgccacaaagaagagattctctatgcagaacttgatccacgccaatcgtgcggtccgggatggatgctcgatgtggctgggcactatgcacgccctgatgtgtttgaattgattgtccacacagagatgcgacccatgatgaagcaagaagaggtaggaggagaaaatacatctgagggaggtgtacgattcttgtaa

SEQ ID NO: 8 - protein, 332 aa, Unknown
  Obtained from an environmental sample
MPSDYHAPFKVAVVQATPVFLDRSATIEKACELIACAGREGARLIVFPEAFIPTYPDWVWTIPPGEMRLLGELYTELLANAVTIPSNATDRLCQAAKRAAAYVVMGMNERNIEASGRSLYNTLLYIDAQGQIMGKHRKLIPTAGERLIWAQGDGSTFQVYDTPLGKLGGLICWENYMPLARYAMYAWGTQIYVAPTWDRGNLWLSTLRHIAKEGGVYVLGCSMVMRKNDIPDHFAFKEQFYATVDEWINVGDSAIVHPEGNFLAGPVRHKEEILYAELDPRQSCGPGWMLDVAGHYARPDVFELIVHTEMRPMMKQEEVGGENTSEGGVRFL

SEQ ID NO: 9 - DNA, 945 bp, Unknown
  Obtained from an environmental sample
atggcggctcacaagatcgcggtggttcaggcgcccagcgttctcctcgatcgcgagggctcggtcgcgcgcgcggtcacgctgctcgacgaggcggcggcggccggcgcccgcctggtcgtgtttccggaggcctacatccccggctacccggactggatctggcgcctgcgcccctacccggacgtcaagctggccgccgagctgcacgaacggctgctcgccaacgcggtggatctctccaccgacgtgctggcgccggtgctggcggcggcggcgcgtcacgggctcaccgtggtcatgtgcgtgcaggagcgcgacgccggattcagccgcgccacactttacaacaccgcgctggtcatcgacgccgccggcaagatcgcgaaccggcaccgcaagctcatgcccaccaaccccgagcgaatggtgtggggattcggtgacgcctcggggctgcgggtggtgagcacgcccgtcgggcgggtgggcacgctcctgtgctgggagagctacatgcccctggcgcgctgcgcgctctacgccgagggggtcgagatctacgtgaccccgacctgggactacggcgaaggctggcgcgccagcatgcagcacatcgcccgcgaggggcgctgctgggtggtgaccgcttgcatgtgcgtgcaggcgcgcgacgtgccggccgacttccccgggcgcgcccagctctaccccgacgaggaggagtggttgaaccccggcgattcgctggtggtcgaccccggcggcaagatcgtggccggtccgatgtcgcgcgagaaggggatcttgtacgcggagatcgatccggatcgcgtggcgggggcgcaccgctcgttcgacgtcgtgggccactactcgcgtcccgacgtgttccggctggaggtcgatcggacaccggcggcgccggtgagcttcaaaaaatga

SEQ ID NO: 10 - protein, 314 aa, Unknown
  Obtained from an environmental sample
MAAHKIAVVQAPSVLLDREGSVARAVTLLDEAAAAGARLVVFPEAYIPGYPDWIWRLRPYPDVKLAAELHERLLANAVDLSTDVLAPVLAAAARHGLTVVMCVQERDAGFSRATLYNTALVIDAAGKIANRHRKLMPTNPERMVWGFGDASGLRVVSTPVGRVGTLLCWESYMPLARCALYAEGVEIYVTPTWDYGEGWRASMQHIAREGRCWVVTACMCVQARDVPADFPGRAQLYPDEEEWLNPGDSLVVDPGGKIVAGPMSREKGILYAEIDPDRVAGAHRSFDVVGHYSRPDVFRLEVDRTPAAPVSFKK

SEQ ID NO: 11 - DNA, 966 bp, Unknown
  Obtained from an environmental sample
atgactggatcttatcctaaagacacactgatcgttgggctagctcaaatcgctcctgtctggctggatcgggcggggacactgtcaaagatactggctcaagtccatgcggcaaatcaagcgggttgtcatctcgtagcatttggcgaagggctgcttcctggatatccgttttggattgagcgaacaaatggcgcgctgttcaactcgactgtacaaaaggaaatccacgcgcattatatggatcaggcggtgcagatcgaagccggtcatctcgatccgctttgtgcaacagccaagaaatttggaatcaccgttgtactcggatgcatcgaacgcccactcgatcggggcggtcacagcttgtatgcaagtctggtatatattgattccgagggcagcattcaatccgtgcatcgcaaactaatgccaacctacgaagaacgacttacctggtcgtcaggcgatgggcacggtttacgagtgcataccttaggtgcgtttacggtgggtggtctcaactgttgggaaaattggatgcccttggcgcgcgcagcgatgtatggtcagggtgaagatttacatgttgcgatctggccaggcggttctcatctcacgcaggatattacccgctttattgcgctcgaatcacgttcgtacgtattatctgtctccggtctgatgcgcgcaaccgattttccaaaagatactccccatcttgcctccatcctagctaaaggtgaagagattcttgcgaatggtggttcttgtattgcaggtcctgacggcaagtgggtcgttgggcctcttgtaggagaagagaagttaattgtcgcaaccattgatcactgccgcgtgcgcgaagaacgtcagaatttcgatccttccgggcattacagccggcccgatgtactgcaattaaaaatcaacagggaacgccagagcacaatttcatttagcgagtag

SEQ ID NO: 12 - protein, 321 aa, Unknown
  Obtained from an environmental sample
MTGSYPKDTLIVGLAQIAPVWLDRAGTLSKILAQVHAANQAGCHLVAFGEGLLPGYPFWIERTNGALFNSTVQKEIHAHYMDQAVQIEAGHLDPLCATAKKFGITVVLGCIERPLDRGGHSLYASLVYIDSEGSIQSVHRKLMPTYEERLTWSSGDGHGLRVHTLGAFTVGGLNCWENWMPLARAAMYGQGEDLHVAIWPGGSHLTQDITRFIALESRSYVLSVSGLMRATDFPKDTPHLASILAKGEEILANGGSCIAGPDGKWVVGPLVGEEKLIVATIDHCRVREERQNFDPSGHYSRPDVLQLKINRERQSTISFSE

SEQ ID NO: 13 - DNA, 1014 bp, Unknown
  Obtained from an environmental sample
atgggcattcaacatccgaaatataaggttgcggtggtgcaggcggcgccggcctggctcgatctcgatgcgtcgatcgccaaatcgatcgcgttgatcgaggaggcggctgccaatggcgccaagctgatcgccttcccggaggcgttcatccctggctatccctggtatatctggctggactcgccggcctgggcgatcggccgcggttttgtgcagcgctatttcgacaactcgctggcctatgacagcccgcaggccgagaagctgcggctggcggtgaagaaggccggcctcaccgccgtgatcggcctctccgagcgcgagggcggcagcctttatctcgcgcaatggctgatcgggcccgatggcgagaccatcgcaaagcgccgcaagctgcggccgacccatgccgagcgcaccgtctatggcgaaggcgatggcagcgatctcgcggtgcatgaccgccccggcatcggccggctcggcgcgctgtgctgctgggagcatctgcagccgctgtcgaaatacgcgatgtatgcccagaacgagcaggttcatgtcgcggcctggccgagcttctcgctctacgacccgttcgcgccggcgctcggctgggaggtcaacaatgcggcctcacgcgtctatgcggtggaaggctcgtgcttcgtgctggcgccctgcgcgacggtgtcgaaggcgatgatcgacgagctctgcgaccgcgacgacaagcacgggctgctgcatgtcggcgggggacacgccgcgatctatgggccggacggctcttcgattgcggagaaattgccgccggagcaggagggcctgctctatgccgacatcgatctcggcgccatcgggattgccaagaacgccgccgatccggccggacattactcgcggcccgacgtgacgcggctgttgctcaacaagaagccgtcgaagcgtgtcgagcatttttcgctgccggtcgacaatgtcgagccggagatcgacgccgccgccagctga

SEQ ID NO: 14 - protein, 337 aa, Unknown
  Obtained from an environmental sample
MGIQHPKYKVAVVQAAPAWLDLDASIAKSIALIEEAAANGAKLIAFPEAFIPGYPWYIWLDSPAWAIGRGFVQRYFDNSLAYDSPQAEKLRLAVKKAGLTAVIGLSEREGGSLYLAQWLIGPDGETIAKRRKLRPTHAERTVYGEGDGSDLAVHDRPGIGRLGALCCWEHLQPLSKYAMYAQNEQVHVAAWPSFSLYDPFAPALGWEVNNAASRVYAVEGSCFVLAPCATVSKAMIDELCDRDDKHGLLHVGGGHAAIYGPDGSSIAEKLPPEQEGLLYADIDLGAIGIAKNAADPAGHYSRPDVTRLLLNKKPSKRVEHFSLPVDNVEPEIDAAAS

SEQ ID NO: 15 - DNA, 1047 bp, Unknown
  Obtained from an environmental sample
atgccaacatcaaaacaatttagagtcgctgcagttcaagccgccccggtatttcttgacctggagggcgcaataagcaaaggcatctccctcattgaggaggccgcttccaatggagccaagctcattgccttcccggaaacgtggattcccggctacccctggtggatctggctggactcacccgcttggggcatgcgctttgtccagcgctattttgacaactcgctcatgctgggtagtgagcaagccaagcgcatgaaccaggctgccgccaataacaagatttacgtggtgatgggttatagcgaacgcagtggcggcagcctctacatgggccaatccattatcaacgacaagggtgaaacgatttttacccgccgcaaactcaagccaactcatgtcgagcgtaccgtgtttggggagggagacggcagccatctttgcgtaatggataccgagattggccgcgtcggcgcgatgtgctgttgggaacatttgcagccgctcagcaaatatgcaatgtattctcaggatgaacaaattcacattgcctcctggccgagcttttcgttatatcggggggcagcctatgcactcggccccgaactgaacaacgccgccagccaaatgtatgcagccgaaggccagtgctttgtccttgccccttgcgccaccgtctcaaaggagatgatcgaaatgctgatagatgatcccaggaaagagccgcttctgctggaaggtggcgggttcaccatgatttacggccccgatgggcgacctctggctaaaccgttgcctgaaaacgaggaagggctgctatatgccgatattgacctgggcatgatttcaatggccaaggctgccgccgacccggcaggtcactacgcacgcccggatgtcactcgcctactattcaattccgcgcccgccaatcgcgtcgagtatatcaacccagcgtcaggcccaaccgaatccttaaaagatatgggaaagatgcaaatggaggccgaacagcaaaaggcggccctgcgagagatgatctaa

SEQ ID NO: 16 - protein, 348 aa, Unknown
  Obtained from an environmental sample
MPTSKQFRVAAVQAAPVFLDLEGAISKGISLIEEAASNGAKLIAFPETWIPGYPWWIWLDSPAWGMRFVQRYFDNSLMLGSEQAKRMNQAAANNKIYVVMGYSERSGGSLYMGQSIINDKGETIFTRRKLKPTHVERTVFGEGDGSHLCVMDTEIGRVGAMCCWEHLQPLSKYAMYSQDEQIHIASWPSFSLYRGAAYALGPELNNAASQMYAAEGQCFVLAPCATVSKEMIEMLIDDPRKEPLLLEGGGFTMIYGPDGRPLAKPLPENEEGLLYADIDLGMISMAKAAADPAGHYARPDVTRLLFNSAPANRVEYINPASGPTESLKDMGKMQMEAEQQKAALREMI

SEQ ID NO: 17 - DNA, 993 bp, Unknown
  Obtained from an environmental sample
atgagagttgttaaagccgcagctgtccaactgagtcccgtcctctatagccgcgagggaacggtcgagaaggtcgtgcggaagatccatgaacttgccgaagagggagtcgagttcgtcacctttcctgagaccgtggtgccttattacccgtacttttcgttcgttcagacgcccttgcagcaaatcttcggaacagagtatctgaggctgctcgaccaggcagtcaccgtgccatccgccgccaccgacgcgatcggcgaggctgccaggttcgctggagttgttgtctcgatcggcgtcaacgagcgagacgggggaactctgtacaacactcagcttctcttcgatgccgacggaagcttaattcagcggcgccgcaagatcacgcccacccattacgagcgcatgatctggggccagggtgacggctcaggtctgcgggccgttgatagcaaggccggccgcattggtcagctggcatgctgggagcacaacaatccactggcgcgctacgcgctgatagccgacggcgagcagatccattcggccatgtatccgggctccatgttcggcgactcgtttgccaaaaagaccgaaatcaatatccggcagcatgcgctggagtctgcgtgcttcgtcgtgaacgcaacggcctggctggacggcgatcaacaggcgcaaatcatgaaggacaccggctgcagcatcggcccgatctccggcggttgcttcaccactatcgtggcgccggacggttccctgatcggcgagcccctccgctcgggtgagggcgtggtcatcgccgacctcgacttcacgttaatcgacaggcgtaagcaggtgatggactcgcgaggccactacagccggccggagttgctcagcctcttaatagaccgcacccctaccgcgcactttcacgaacgcgcttcgcaccccacgacaggagctgagcaaggctccgaggatgtgttcgaggctaacatttaa

SEQ ID NO: 18 - protein, 330 aa, Unknown
  Obtained from an environmental sample
MRVVKAAAVQLSPVLYSREGTVEKVVRKIHELAEEGVEFVTFPETVVPYYPYFSFVQTPLQQIFGTEYLRLLDQAVTVPSAATDAIGEAARFAGVVVSIGVNERDGGTLYNTQLLFDADGSLIQRRRKITPTHYERMIWGQGDGSGLRAVDSKAGRIGQLACWEHNNPLARYALIADGEQIHSAMYPGSMFGDSFAKKTEINIRQHALESACFVVNATAWLDGDQQAQIMKDTGCSIGPISGGCFTTIVAPDGSLIGEPLRSGEGVVIADLDFTLIDRRKQVMDSRGHYSRPELLSLLIDRTPTAHFHERASHPTTGAEQGSEDVFEANI

SEQ ID NO: 19 - DNA, 1050 bp, Unknown
  Obtained from an environmental sample
atggaaagcaacttccttgccgcagcagtgcaagcagaaccggtttacttcaatgcttttcagacggccgaaaaggccgcgtcattgattgacgatgccggtcggcagggggctcgcttagtgacatttcccgaaacgtggctgcccggttacccgtactggatctggcttggtgcccccgcctggggaatgcatcatttcatcctaaagtaccatcaaaactcgccggttgcaggaggaccagaggaacagatcctttgtcaggcggcccgccgcaacgggatttttgtcgtcatgggactcagcgagaaaatcggggcaagcctctacatggcgcagtggttcatcagtccagacggcaaagtggtcgctcgccgacgcaaattgaagcctactcacgtcgaacgttcggtcttcggggaaggggatggttccgacattgtcgttcttgatacaccccttggaaaggtcgggggcctttgctgctgggagcacatgcagccactttcgaagtacgccatgtactcgcaaggcgagcagatccatgctgcttcttggccgagtgttagcgtctatcgcgataaaatttacgttctggggccggagctgaacggtgccgccaatcagatgtatgcggcagaaggtcagtgtttcgtcctggcatcctgggcaacggtttcacaagcggctatcgatcttttttgcgacacgcccgacaaggccgcgctcatgaaaattggtggtggtttttcccagatctatgggccagacgggtgccccctggcgaagccgttgccggaggacgtcgaaggattggtgaccgctgagattgacttcaatgccatcacgcgcgtgaaagcagcggcggaccccgtagggcactatagccggcccgatgtattccgcctgttgttcaatcgtacgcgccaagaacgcgtggtttctgtcaacacgtttgtgccaggtgtcacccagcgaaccgccaagaatgggtcggcggacgaattggtcggtcacccggagaacgctgtcgcccgggctgcagagtaa

SEQ ID NO: 20 - protein, 349 aa, Unknown
  Obtained from an environmental sample
MESNFLAAAVQAEPVYFNAFQTAEKAASLIDDAGRQGARLVTFPETWLPGYPYWIWLGAPAWGMHHFILKYHQNSPVAGGPEEQILCQAARRNGIFVVMGLSEKIGASLYMAQWFISPDGKVVARRRKLKPTHVERSVFGEGDGSDIVVLDTPLGKVGGLCCWEHMQPLSKYAMYSQGEQIHAASWPSVSVYRDKIYVLGPELNGAANQMYAAEGQCFVLASWATVSQAAIDLFCDTPDKAALMKIGGGFSQIYGPDGCPLAKPLPEDVEGLVTAEIDFNAITRVKAAADPVGHYSRPDVFRLLFNRTRQERVVSVNTFVPGVTQRTAKNGSADELVGHPENAVARAAE

SEQ ID NO: 21 - DNA, 1065 bp, Unknown
  Obtained from an environmental sample
atggcactagaacatccgaagtacgtggcggccgtggttcaggccgcgcccgaattcctgaatctagacagagggatcgaaaagacgatcgcattgatcgacgaagcgggacagaaaggggcggccctgattgcatttccggaaacctggctgccgggctatccgtttcatgtctggctcggtcctcccgcatgggcgcttggctcaggattcgtccagcgctatttcgacaactcgatgacgtacgatagtcctcaggccgctgcactgagggacgctgccgcgcgcaacgggatcacggtggtattgggcttgtcggagcgatgcggcggcagcctctatatcgcgcaatggatcatcggcccggatggcgcgacggtcgccacgcgccgcaaattgcggccgactcatatcgagcgcaccgttttcggcgatggcgacggcagcgatctggcagtacacgatctcaacatcggccgccttggcgcactgtgctgctgggagcacattcagccgctgaccaagtacgcgatgtatgcgcagcacgaacaggtgcacgtcgcggcctggccgagcttctccatgtatgaattcgcgcccgcgctcggtcacgaggtgaacaacgcagtcagccgcgtctatgccgttgagggatcgtgcttcgtgctcgcgccgtgcgcggtcatcagcgagcaaatggtcgacatgttgtgcgacacggcagacaagcgcgcgatgatacgtgccggcggcgggcacgcagtggcgttcgggccggacggcgaagctctggtcgagaaactgccggaaaatgaggaaggcttgctgctggtcgatatcgatctcggtcgcatctcgcttgcgaaggctgcggccgaccccgtcggtcactacgcgcgccccgatgtcttgcggctctggttcgacaagcaaccgcggcggtgcgtcgaacatgccggcgagaacgacgcgtcgcgcaggtcgcacgggtcgtccgggtcacaatcgccggcgcaggatgggccggcgaacgacatggtagaccgtcaggaaaacgtcgattga

SEQ ID NO: 22 - protein, 354 aa, Unknown
  Obtained from an environmental sample
MALEHPKYVAAVVQAAPEFLNLDRGIEKTIALIDEAGQKGAALIAFPETWLPGYPFHVWLGPPAWALGSGFVQRYFDNSMTYDSPQAAALRDAAARNGITVVLGLSERCGGSLYIAQWIIGPDGATVATRRKLRPTHIERTVFGDGDGSDLAVHDLNIGRLGALCCWEHIQPLTKYAMYAQHEQVHVAAWPSFSMYEFAPALGHEVNNAVSRVYAVEGSCFVLAPCAVISEQMVDMLCDTADKRAMIRAGGGHAVAFGPDGEALVEKLPENEEGLLLVDIDLGRISLAKAAADPVGHYARPDVLRLWFDKQPRRCVEHAGENDASRRSHGSSGSQSPAQDGPANDMVDRQENVD

SEQ ID NO: 23 - DNA, 1005 bp, Unknown
  Obtained from an environmental sample
atgaccgttatcaaagcagccgccattcaaatcagccccgtgctctacagccgggcggggacagtcgagaaagttgttaggaaggttagagagctcggggccaaaggtgtccgattcgctacctttcccgaaaccatcataccgtactacccgtacttctcgttcgttcagtcggcgttcgacatgaagcttgggagtgaacatcagcggctgctcgacgaatcagtcacaattccttcgtccgagacggacgcgatcgcccaggccgccaaggaagcgggcatggtggtgtccgtcggggtcaatgagcgcgatgggcgatccatctacaacactcaacttctgttcgacgctgatggcacgctcattcagcgtaggcgaaagatcaccccgacctatcacgagcgcatgatttggggtcaaggcgatggatccggcctacgcgcggtcgatagcgccgtgggccggatcggccagcttgcctgctgggagcactaccttcccctggcgcggtacgccctcatcgcggacggagagcaaatccactcggcaatgtatccaggctcgttcgctggtccgctatttgccgagcagatagaggttagtatccgccagcacgcgcttgagtcagcctgcttcgtcgtcaacgcgaccggatggcttagcgccgagcagcaagctcaaatagtgaaggataccggatgcgtcgttggaccaatctccggtggctgctttacggcgattgttgatccggagggtcggatcatgggggcgccactcaaggcaggtgagggggaggtcatcgcagatctcgattttgcgcagattgatttccgcaagcgtgtgatggatacgcgagggcactacagccgccccgaacttctaagcctcacgatcgaccgcagtcagcaccatcacatgactgagcgaggcgccgatcaccgtgtagaccacgcaaagccaacggtcaccgcagagcagtcggccgtcgagccggcggaatga

SEQ ID NO: 24 - protein, 334 aa, Unknown
  Obtained from an environmental sample
MTVIKAAAIQISPVLYSRAGTVEKVVRKVRELGAKGVRFATFPETIIPYYPYFSFVQSAFDMKLGSEHQRLLDESVTIPSSETDAIAQAAKEAGMVVSVGVNERDGRSIYNTQLLFDADGTLIQRRRKITPTYHERMIWGQGDGSGLRAVDSAVGRIGQLACWEHYLPLARYALIADGEQIHSAMYPGSFAGPLFAEQIEVSIRQHALESACFVVNATGWLSAEQQAQIVKDTGCVVGPISGGCFTAIVDPEGRIMGAPLKAGEGEVIADLDFAQIDFRKRVMDTRGHYSRPELLSLTIDRSQHHHMTERGADHRVDHAKPTVTAEQSAVEPAE

SEQ ID NO: 25 - DNA, 939 bp, Unknown
  Obtained from an environmental sample
gtgtcatcaactatcaaagtcgccattattcaggccgctcctgcttactacgacctgcaggcgtcgctggcaaaggccgccagtctgatccgcgaggcggcacgcggcggcgcgcaattcgtcgcgttcggggagacatggctgccgggctatccgatgtggctggattggtgtcctggcgcgatcatctgggataaccccgccaccaaaaccgtcttcgcgcgcctccatgaaaacagcgtcgccgttcccggcagggaaacggcatttctcgccgaccttgcgatgtcgttaagcatcgtattatgcatcggcgtcaatgagaaggtcatgaatgggccgggacacggcacgctctacaacacgctcctgacgtttgatgcaacgggtgaaatcatcaatcatcatcgcaagttgatgccaacctatggcgagagattggtatgggggccgggcgacgcagttggcgtgcaagcggttgatagtacggtcgggcgcatcggcgggctgatctgttgggagcactggatgccgctgccacgccaactcatgcacaacagcggcgagcagattcacgtctgcgcatggccgggcgtgcacgaaatgcaccagatcgcgagccgtcattatgcattcgagggccgctgctttgtgctggccgccggattgatcatgcccgcgttcgacctgcccagcgaactcgaatttccgcccgaactggccgacaagcgcgactatctcctaatgaacggcggcagcgccatcatcaagcccaatggcaaatatctcgccgggccggtttatgacgaagagactattctctgcgccgaccttgacctgactgagaacatcaaggagcagatgacgctggacgtgacagggcattatgcgcgagcggaactgtttgacttgaatgtggtgcggcggcggaatgcgtag

SEQ ID NO: 26 - protein, 312 aa, Unknown
  Obtained from an environmental sample
VSSTIKVAIIQAAPAYYDLQASLAKAASLIREAARGGAQFVAFGETWLPGYPMWLDWCPGAIIWDNPATKTVFARLHENSVAVPGRETAFLADLAMSLSIVLCIGVNEKVMNGPGHGTLYNTLLTFDATGEIINHHRKLMPTYGERLVWGPGDAVGVQAVDSTVGRIGGLICWEHWMPLPRQLMHNSGEQIHVCAWPGVHEMHQIASRHYAFEGRCFVLAAGLIMPAFDLPSELEFPPELADKRDYLLMNGGSAIIKPNGKYLAGPVYDEETILCADLDLTENIKEQMTLDVTGHYARAELFDLNVVRRRNA

SEQ ID NO: 27 - DNA, 1056 bp, Unknown
  Obtained from an environmental sample
atgccaacccccagcgatcatttcaaaatcgccgctgttcaggcctcgcccgtgtttctggaccgggaggccactgtggaaaaggcctgccggttgatcgccgaagccgcaaagcagggcgcccgcctcatcgtctttccggaatctttcatcccgacctacccggattgggtgtgggccgttcccccgggaagggaaagaatcctgaaccagctgtattctgaattcctggccaatgccgtcgatgttcccggcgcggcgaccgaacaacttgcccaggctgcacgaatggccggcgcctatgtgattatgggcgtcaccgaaagagacacctcggccagcggggccagcctctacaacaccctgctctacttcagccccgaaggcatcctaatgggcaaacaccggaagctggttcccacggggggcgaacggctggtctgggcctacggagacggcagcacgctggaggtctacgacactccgctgggaaagatcggcgggctgatctgctgggagaactacatgcccctggcccggtacacgatgtacgcctggggcacccagatttacatcgccgccacctgggaccgcggggaaccgtggctctccaccctgcggcatatcgccaaggaaggaagggtctacgtcatcgggtgctgcatcgccctgcgccagggggatatcccggaccggttcgagtacaagggaaaattttattccgggtcccgggagtggatcaatgagggcgacagcgccatcgtgaacccggacggggaattcatcgccgggccggtgcggatgaaggaggagatcctgtatgccgagatagacccccggcagatgcggggccccaagtggatgctcgatgtggccggtcattacgcccggccggatatcttcgagctcatcgtccaccggaatccccacccgatgatcaaaatcgccgaagacaggggcacggggatcgcctcaagtttgattcgcccccgccctaaccttcccccatcaagggggaggaaatcggcaagaagcaaacgcaagcccaaaaaatga

SEQ ID NO: 28 - protein, 351 aa, Unknown
  Obtained from an environmental sample
MPTPSDHFKIAAVQASPVFLDREATVEKACRLIAEAAKQGARLIVFPESFIPTYPDWVWAVPPGRERILNQLYSEFLANAVDVPGAATEQLAQAARMAGAYVIMGVTERDTSASGASLYNTLLYFSPEGILMGKHRKLVPTGGERLVWAYGDGSTLEVYDTPLGKIGGLICWENYMPLARYTMYAWGTQIYIAATWDRGEPWLSTLRHIAKEGRVYVIGCCIALRQGDIPDRFEYKGKFYSGSREWINEGDSAIVNPDGEFIAGPVRMKEEILYAEIDPRQMRGPKWMLDVAGHYARPDIFELIVHRNPHPMIKIAEDRGTGIASSLIRPRPNLPPSRGRKSARSKRKPKK

SEQ ID NO: 29 - DNA, 1017 bp, Unknown
  Obtained from an environmental sample
atgggcatcgaacatacgaaatacaaggtggcggtggtgcaggcggcgccggcctggctcgacctcgaggcctcgatcggcaagtccatcggcctaatcaaggaggccgcggacaagggcgccaagctgatcgcctttccggaggccttcatccccggttacccctggtatatctggatggactcgccggcctgggcgatcggccgcggcttcgtccagcgctatttcgacaattcgctctcctacgacagtccccaggccgagcggctgcgtgatgccgtgcgccaggccaagctcaccgccgtgatcggcctgtccgaacgcgacggcggcagcctttacctggcgcaatggttgatcgggcccgacggcgaaaccattgccaagcgccgcaagctgcggccgacccatgccgagcgcaccgtctatggcgaaggcgacggcagcgatctggccgtacatgcccggcccgacatcggtcgcttgggcgcgctgtgctgctgggagcatcttcagccgttgtcgaagtacgcaatgtacgcccagaacgagcaggtccacgtcgctgcctggccgagcttctcgctctacgatcccttcgccccggcgctcggcgccgaggtcaacaacgctgcctcgcgcgtctatgcggtggagggctcctgcttcgtgctcgcgccttgcgcgacggtgtcgcaggccatgatcgacgaactctgcgatcggcccgataagcatgcgctgctgcatgccggcggaggctttgccgcgatctacggccccgacggcagccagatcggcgagaagctggcgccggatcaggagggtctgctgatcgccgagattgatctgggcgccatcggtgttgccaagaacgcggcagatcccgccggtcattattcacggccggatgtgacgcggttgctgctcaacaagaagcggtaccagcgcgtcgagcaatttgccttgcccgccgacatggtcgagcccgcggacataggcgcggcggcgagctga

SEQ ID NO: 30 - protein, 338 aa, Unknown
  Obtained from an environmental sample
MGIEHTKYKVAVVQAAPAWLDLEASIGKSIGLIKEAADKGAKLIAFPEAFIPGYPWYIWMDSPAWAIGRGFVQRYFDNSLSYDSPQAERLRDAVRQAKLTAVIGLSERDGGSLYLAQWLIGPDGETIAKRRKLRPTHAERTVYGEGDGSDLAVHARPDIGRLGALCCWEHLQPLSKYAMYAQNEQVHVAAWPSFSLYDPFAPALGAEVNNAASRVYAVEGSCFVLAPCATVSQAMIDELCDRPDKHALLHAGGGFAAIYGPDGSQIGEKLAPDQEGLLIAEIDLGAIGVAKNAADPAGHYSRPDVTRLLLNKKRYQRVEQFALPADMVEPADIGAAAS

SEQ ID NO: 31 - DNA, 933 bp, Unknown
  Obtained from an environmental sample
atgaccagaatagccattattcagcgaccgcccgtgctgctcgatcgaagcgccaccattgcccgggccgtgcaatcggtcgccgaagcggcagcgcaaggcgcgaccctgattgtcttgcccgaatcgtacatccctggctatccctcatggatctggcggctcgcgcctggcaaagacggcgcgatcgtgggccagttgcatgcgcgcttgctggccaatgcggtcgacctgagcagcactgacctcgatgcgcttcttgaagcggcccgtcagcacggcgtgaccattgtttgcggcatgaacgagtgcgaacggcgtcgcggcggcggcaccttgtacaacacggtggtcgtgatcggaccggacggcgtcatgctcaaccggcatcgcaaattgatgccgaccaatcccgagcgcatggtgcatggctttggcgatgcatccggactgaaagcagttgatacgcctgccggccggctgggcacgctgatctgctgggagagctacatgccgctggcacgctatgccctgtacgagcaaggcatcgagatctacatcgcaccaacttatgacagtggtgacggctggatcagcaccatgcgccacattgcactcgaagggcgctgctgggtgattggcagcggcacggtcctgaaaggcagtgatattccggacgatttcccggaacgggcacgcctgttccctgatccggatgagtggatcaacgatggtgattcggtagttatcgatccgcagggaaagatcgttgccggtccgatgcgtagggaagcaggcattctatacgccgatatcgacgtcgcgcgcgtagcaccatcacgccgcacgctggatgtcgcggggcattacgcgcgtccggacgtcttcgagcttcgggtacaccaggcaccgggggcacgagtaagtaattga

SEQ ID NO: 32 - protein, 310 aa, Unknown
  Obtained from an environmental sample
MTRIAIIQRPPVLLDRSATIARAVQSVAEAAAQGATLIVLPESYIPGYPSWIWRLAPGKDGAIVGQLHARLLANAVDLSSTDLDALLEAARQHGVTIVCGMNECERRRGGGTLYNTVVVIGPDGVMLNRHRKLMPTNPERMVHGFGDASGLKAVDTPAGRLGTLICWESYMPLARYALYEQGIEIYIAPTYDSGDGWISTMRHIALEGRCWVIGSGTVLKGSDIPDDFPERARLFPDPDEWINDGDSVVIDPQGKIVAGPMRREAGILYADIDVARVAPSRRTLDVAGHYARPDVFELRVHQAPGARVSN

SEQ ID NO: 33 - DNA, 1026 bp, Unknown
  Obtained from an environmental sample
atgttaagtcccgtgacgcagtatcgcgccgccgcggtgcaggcggcgccatcttttctcgatctcgaccgcaccgtcgagaagacgatcgcgatcatcgagcaggcggccgagcaggatgtgcgcctgatcgcgtttccggaaacctggattcccggctatccgctctggatctggctcggctcgccggcctggggcatgcgcttcgtgcagcgctatttcgagaactcgctggtgcgcggcagcaaacagtggaacgcgatcgccgatgcggcgcggcgccaccgcatgaccgtcgtcgtcggcttcagcgagcgcgcgggaggcagcctctacatgggccaggcgatcttcggccccgaaggcgagctcatcgcggcgcgccggaagctcaagccgacacacgccgagcgaacggtgttcggcgagggcgacggcagccacttggccgtttacgagacgggcgttggtcgcatcggcgccctctgctgctgggagcacatccagccgctctcgaaatacgcgatgtatgcggccaacgaacaggtgcatgtggcctcgtggccgtgcttcagcctttatcgcggcatggcctatgcgctcgggccggaggtgaacaccgccgcgagccaggtctacgcggtcgagggcggctgctacgtgctggcctcctgtctcgtcgtgacacccgagatcctgaaggtgctgatcgacacgcccgacaaggagccgttgctgctcgccggcggggggttctcgatgatcttcggccccgacggccgcgcgctcgcccagccgctgccggagaccgaagaggggctcgtcacggccgagatcgatctcggcgcgatcgcgctcgccaaggccgcggccgatcccgccggccattacgcgcggcccgacgtgacgcggttgttgctgaacccgcgccccgcggcgcgcgtcgaagcgctgggtccgcgcttcgaggtcgtgcagagcgagcaggccgagccgcccacgcaaccggccgaagcggcggattga

SEQ ID NO: 34 - protein, 341 aa, Unknown
  Obtained from an environmental sample
MLSPVTQYRAAAVQAAPSFLDLDRTVEKTIAIIEQAAEQDVRLIAFPETWIPGYPLWIWLGSPAWGMRFVQRYFENSLVRGSKQWNAIADAARRHRMTVVVGFSERAGGSLYMGQAIFGPEGELIAARRKLKPTHAERTVFGEGDGSHLAVYETGVGRIGALCCWEHIQPLSKYAMYAANEQVHVASWPCFSLYRGMAYALGPEVNTAASQVYAVEGGCYVLASCLVVTPEILKVLIDTPDKEPLLLAGGGFSMIFGPDGRALAQPLPETEEGLVTAEIDLGAIALAKAAADPAGHYARPDVTRLLLNPRPAARVEALGPRFEVVQSEQAEPPTQPAEAAD

SEQ ID NO: 35 - DNA, 942 bp, Unknown
  Obtained from an environmental sample
atgacagctctaaaaattgctgctgttcaaatgtgcgccgaattgggcgctacagatcgaaacctgagtgcagctggatcattcgtgcgcgacgcatttcgcgaaggtgcccagtgggtaatcctcccagagttttttacctcggcaatggcattcgcaccttcgatggcgcaagcttggttgccactggaaggaaaggcgctagcgatgatgcgcagccttgcgcgtcaattcgatggggttgttggaggctcatatgttgccagagaggggaacgactgcgtaaatgcctttcttctcgtctttccggatggaagctactaccggcatgacaaagatattccaacaatgtgggagaactgttactacatcggcggcgtcgacgatggggtgctggaaacaccaattggtgcggtgggagttgcactgtgttgggagttcatccgaacacaaaccgcccgaagactgaaggatcgcgttcaattagtggttggcggtacttgctggtgggattttccgatgcctgtacctgaacgatatctgaggctgaccaggcatatctccaggaactttgagcgcgatgctccggcgcggttggccagtatgttgggtgtgcctgttgtacacgcttcccatgctggggattttactgctgtcaccccaggcaatgaaacgaagaattaccgatccaactatctgggagagacccagatcgtcgatgccaatggaaatgtgttgaagcgaatgacagtggctgatggtgagggttacgtcattgctgacgttcaattgggggccatatcaaccggtcgaacttcgatccccgacaccttctggacctgcaagctaacgccaggggcacaacaggcttgggatgaacaaaatgcttttgggtgtggctactatgagaacgtcacacgcaaacacctaatcggtcgatga

SEQ ID NO: 36 - protein, 313 aa, Unknown
  Obtained from an environmental sample
MTALKIAAVQMCAELGATDRNLSAAGSFVRDAFREGAQWVILPEFFTSAMAFAPSMAQAWLPLEGKALAMMRSLARQFDGVVGGSYVAREGNDCVNAFLLVFPDGSYYRHDKDIPTMWENCYYIGGVDDGVLETPIGAVGVALCWEFIRTQTARRLKDRVQLVVGGTCWWDFPMPVPERYLRLTRHISRNFERDAPARLASMLGVPVVHASHAGDFTAVTPGNETKNYRSNYLGETQIVDANGNVLKRMTVADGEGYVIADVQLGAISTGRTSIPDTFWTCKLTPGAQQAWDEQNAFGCGYYENVTRKHLIGR

SEQ ID NO: 37 - DNA, 993 bp, Unknown
  Obtained from an environmental sample
atggattcagatatgacggatacttttaaggcagccattattcagcacgcgcctgtttttttaaatctcgaagagagtctggacaaagccggcagccttatagaaaaggctgccgatcaaggcgcgaaagtgatcgcctttcctgaaacatggctgcccggttatcccgtatggctcgactactctccaaaagcgggtctgtgggactatcagcctgcaaaatctctctatcgtctgctagtcgataattcagtcaccttacccggcaaacacctcgatcaactcctctccatagcgcaaaagaccggcgcatatgttgtaatgggggcacacgaacgagtgggtggaacactctataacacgacgatctatgttgggattgatgggaaggagtacaaacttcatagaaagctggtgccgacctataccgaaagattgatctgggggcggggagacggcagcacattgagtgtgttgatgacggattatggcgttcttggaggattgatctgctgggagcactggatgcctctggcaagagccgcaatgcatgccagatatgaaacccttcatgtggcgcaatggccggctgtaaaagatatccatcagatagcaagcagacattatgcttttgaaggccggtgtttcgtgctcgcggcaggctctgttctgactcgaagagatataatagaaggattcaactcactggctcgcgccgatagtgatgcattggaacttctgaaagctatttcgggagaagatagtgatcttattttgaatgggggaagcgcgataattgcgccgaatggagagtatcttgcgggcccggtctttaatgaaccctccattatttatgctgaaattgatcctgcactgataagtgagggccatcttacactggatacaagcggacactactcgcgccctgacatttttcgtctggagataaacgatcaacctcaacatgatgtaactttcagatcggggcattag

SEQ ID NO: 38 - protein, 330 aa, Unknown
  Obtained from an environmental sample
MDSDMTDTFKAAIIQHAPVFLNLEESLDKAGSLIEKAADQGAKVIAFPETWLPGYPVWLDYSPKAGLWDYQPAKSLYRLLVDNSVTLPGKHLDQLLSIAQKTGAYVVMGAHERVGGTLYNTTIYVGIDGKEYKLHRKLVPTYTERLIWGRGDGSTLSVLMTDYGVLGGLICWEHWMPLARAAMHARYETLHVAQWPAVKDIHQIASRHYAFEGRCFVLAAGSVLTRRDIIEGFNSLARADSDALELLKAISGEDSDLILNGGSAIIAPNGEYLAGPVFNEPSIIYAEIDPALISEGHLTLDTSGHYSRPDIFRLEINDQPQHDVTFRSGH

SEQ ID NO: 39 - DNA, 1008 bp, Unknown
  Obtained from an environmental sample
atgaaaaatatcaaaaactcagaaaaaagcagcacagtaagagtcgctgcggtacaaatcagtccggtgttgtacaaccgcgaagctaccgttcaaaaagtagtcaacaaaatccttgaactaggaaaacaaggggtacaattcgccacttttccggaaacgatagtgccttattatccttatttctcttttattcaggcgccttatgccatgggcaaagaacacctgcgcttgcttgaacaatcagttactgttccgtcagccgcgaccgatgccataagtgaggcggcaaaggaagccaatatggtagtgtctattggtgtcaatgaacgagacggtggtaccatttacaatacgcaactcctttttgatgctgacggaacattaattcagcgcagacgtaaacttacaccaacgtatcatgaaagaatgatttggggacaaggtgacgcttcaggtcttcgtgccacagacagcgctgttgggcgtatcgggcagttggcttgttgggaacattacaatccattgttccgttatgctttgattgctgatggagaacaaatccattctgccatgtatcccggatcatttttaggtgcgttgcacggtgaacaaaccgaaatcaatgtacgccaacacgctttagaatcggccagcttcgtcgtagtggctaccggttggttggatgccgatcaacaagcacaaattgcgaaagacaccggtggaccaatcggaccaatttcgggaggttgttttacagccgttataggccctgacggacaactaatcggggaagcccttacatcaggtgaaggggaagtgattgccgatattgatttggcacaaattgatgcccgcaaaagattaatggatgccagtggtcactacaaccgtcctgaattgttgagcttgcatatcgatcacactccgactgctcctatgcatgaaagagtagtttacactgagccgggattagcaaaaagacaaaatgaaaattcatcaaattaa

SEQ ID NO: 40 - protein, 335 aa, Unknown
  Obtained from an environmental sample
MKNIKNSEKSSTVRVAAVQISPVLYNREATVQKVVNKILELGKQGVQFATFPETIVPYYPYFSFIQAPYAMGKEHLRLLEQSVTVPSAATDAISEAAKEANMVVSIGVNERDGGTIYNTQLLFDADGTLIQRRRKLTPTYHERMIWGQGDASGLRATDSAVGRIGQLACWEHYNPLFRYALIADGEQIHSAMYPGSFLGALHGEQTEINVRQHALESASFVVVATGWLDADQQAQIAKDTGGPIGPISGGCFTAVIGPDGQLIGEALTSGEGEVIADIDLAQIDARKRLMDASGHYNRPELLSLHIDHTPTAPMHERVVYTEPGLAKRQNENSSN

SEQ ID NO: 41 - DNA, 966 bp, Unknown
  Obtained from an environmental sample
atgcccaatgagaataacatcgctacattcaaagttgccgcagtccaggccacaccggtgtttcttgatcgtgaagcaaccatcgacaaagcttgcgggttgattgccactgccggcaatgaaggagcgcgcctgattgtgtttccagaagcgttcatcccaacctatcctgaatgggtttggggtattccttccggtgagcaaggtttactcaatgaactctatgcagagctgctcaccaatgcggtcactattcccagtgacgcgactgacaggctgtgcgaggccgcgcagcttgcgaatgcctacgtagtgatgggaatgagcgaacggaatgtcgaggcgagtggcgcaagcctatataatacgctgttgtacatcaatgcgcagggggagattttagggaaacatcgaaagctggtgccaacgggcggcgaacgcctggtatgggcgcagggtgatggcagcacgctgcaggtctacgatacgccattgggaaaactcggtggtctcatttgctgggaaaattatatgccgctggcacgctatgctatgtatgcctgggggacacaaatctatgtcgcggcaacgtgggatcgaggccaaccctggctttctacattacggcatatcgccaaagaaggcagggtatacgtgattggttgctgtatcgcgatgcgaaaagacgatattccggatagttactccatgaagcagaaataccatgctgaaatggatgaatggattaatgttggcgacagtgtgattgtcaatcccgaaggacactttatcgcagggcctgtgcgcaagcaagaagaaattctctacgcggagatcgatccacgtatggtgcaaggcccgaagtggatgctcgatgtggcggggcattatgcgagaccagatgtgttccagttgacggtgcatacgaatgtgagagagatgatgcgggtggaagatgattcataa

SEQ ID NO: 42 - protein, 321 aa, Unknown
  Obtained from an environmental sample
MPNENNIATFKVAAVQATPVFLDREATIDKACGLIATAGNEGARLIVFPEAFIPTYPEWVWGIPSGEQGLLNELYAELLTNAVTIPSDATDRLCEAAQLANAYVVMGMSERNVEASGASLYNTLLYINAQGEILGKHRKLVPTGGERLVWAQGDGSTLQVYDTPLGKLGGLICWENYMPLARYAMYAWGTQIYVAATWDRGQPWLSTLRHIAKEGRVYVIGCCIAMRKDDIPDSYSMKQKYHAEMDEWINVGDSVIVNPEGHFIAGPVRKQEEILYAEIDPRMVQGPKWMLDVAGHYARPDVFQLTVHTNVREMMRVEDDS

SEQ ID NO: 43 - DNA, 993 bp, Unknown
  Obtained from an environmental sample
atgagagtcgttaaagccgcggcggtccaactgaaacctgtcctctatagccgagagggaactgtcgaaaacgtcgtccgtaaaatccacgagcttggacagcaaggggtacagttcgcgacgtttccagagactgtggtgccttactacccgtacttttcgatcgtgcagtccggctatcaaattcttggcggtggtgagttcctgaagctgcttgatcagtcagtaaccgtgccatctctcgctacggaagcgatcggcgaggcttgcaggcaggcgggcgtcgttgtctccatcggcgtcaacgagcgtgatggaggaactctatacaacacgcaacttctctttgatgccgacggaacattgattcaaagacgacgcaagatcacacccacccattacgagcgcatggtctggggccagggcgatggctcaggtttacgggccattgacagcaaggtcgcgcgcattggtcaactggcgtgttttgagcactacaaccctctcgcacgttacgcgatgatggccgatggcgagcagatccattctgcgatgttccccggctccatgttcggcgataatttttcagagaaggtggaaatcaacataaggcagcatgcaatggagtctgggtgctttgtcgtttgcgctactgcctggttggatgctgaccagcaggctcaaatcatgaaagacacgggatgtgagatcggaccgatctcaggaggttgcttcacagcgatcgcggcaccagatggaagccttataggtgaacccatccgctcaggtgaaggcgtttgtattgccgacctcgatttcaaacttatcgacaagcggaagcacgtagtagacacacgcggccattatagccggccagaattgctcagcctcctgattgatcggacgccgacggcccacatacacgaaaggaccgagcaaccgagggcggccatcgagaaagagtcgcaggatgttttcaccgctgttgcttaa

SEQ ID NO: 44 - protein, 330 aa, Unknown
  Obtained from an environmental sample
MRVVKAAAVQLKPVLYSREGTVENVVRKIHELGQQGVQFATFPETVVPYYPYFSIVQSGYQILGGGEFLKLLDQSVTVPSLATEAIGEACRQAGVVVSIGVNERDGGTLYNTQLLFDADGTLIQRRRKITPTHYERMVWGQGDGSGLRAIDSKVARIGQLACFEHYNPLARYAMMADGEQIHSAMFPGSMFGDNFSEKVEINIRQHAMESGCFVVCATAWLDADQQAQIMKDTGCEIGPISGGCFTAIAAPDGSLIGEPIRSGEGVCIADLDFKLIDKRKHVVDTRGHYSRPELLSLLIDRTPTAHIHERTEQPRAAIEKESQDVFTAVA

SEQ ID NO: 45 - DNA, 996 bp, Unknown
  Obtained from an environmental sample
gtgaaaccgccgacgtcattccgcgtggccgccgttcaggcctgtcccgtctacctcgatcgcgacctgacgatcggcaaggcagaagggttgatcgccgaggcggctggaaacggcgcgaacctcatcgtgttccccgaagcgttcgtgcctggctatccggtgtgggtgtggttcatcccgcccggtcgcacggcggatcttcgcgaagcgtacagcgtcctccacgccaactcgatcgcggtccccagccagtcgaccgagcgtctgtgcgcggcggcgcggcgcgctggcgtcgccgtggcgattggtgtcaacgaaagaaacagcgaggccagcggcggcagcctcttcaacacgctgctgtacatcggaccggacggcacgctgctcggtaaacaccgaaagctggtgccaacaggcggagagcgtcttgtctgggccagcggcgacggcagcgaccttgccgtgttcacactgcctttcgcgcgagtcggcggactgatctgctgggagaactacatgccgctcgcccgctacgcgctggcggcctggggtgcgcaaatccacgtggcgccgacctgggaccgcggcgagccgtggctctcaacactgcgtcatgtcgcgaaggaaggtagagccgtgacgatcggctgctgtcaggccgtccgcaaggaagacattccggacgggctggcattcaagtcccgatacctggccgacgtgggcgcctgggtcaacccaggcgggagcgtcatcgtcgatcccgacggaaaaattcttgccggacctgcgaacgaaaccgaaggcatcttgtacgctgacatcagggccgatcagctcgtcgggccgagatggcaactcgacattgccggacactacgcgcggccggacgtcttcgagctgatcgtgcatcggcgttcgacgccgatgattcgcgaggtctcggcgcctcgtcgtcgcgcaagaacgggaaagcgaccgcgacgccgctga

SEQ ID NO: 46 - protein, 331 aa, Unknown
  Obtained from an environmental sample
VKPPTSFRVAAVQACPVYLDRDLTIGKAEGLIAEAAGNGANLIVFPEAFVPGYPVWVWFIPPGRTADLREAYSVLHANSIAVPSQSTERLCAAARRAGVAVAIGVNERNSEASGGSLFNTLLYIGPDGTLLGKHRKLVPTGGERLVWASGDGSDLAVFTLPFARVGGLICWENYMPLARYALAAWGAQIHVAPTWDRGEPWLSTLRHVAKEGRAVTIGCCQAVRKEDIPDGLAFKSRYLADVGAWVNPGGSVIVDPDGKILAGPANETEGILYADIRADQLVGPRWQLDIAGHYARPDVFELIVHRRSTPMIREVSAPRRRARTGKRPRRR

SEQ ID NO: 47 - DNA, 1014 bp, Unknown
  Obtained from an environmental sample
gtgaaagaagcaatcaaagtagcctgtgtgcaagcagctccagtctttctcgacctggacgccacagtggacaagaccgtcgccctgattgaggaggcagcccgtaacggcgcacgcctaatcgcctttccagagacctggattccaggctacccatggttcctttggctggactcaccagcctgggggatgcaattcgtgcgccgataccacgagaactcactggtcctcgacagccctcaggccaagcgcatcagtgaggccgcccagcgcgccggtatatacgtcgcgctagggtacagcgaacgcgtgagcggaaccctctacatggggcagtggctcattgacgataagggcgaaacagctgggctgcgccgaaagctgaaaccaacccatgtagagcgaaccctcttcggtgaaggcgacggatcatccctttccactttcgacacaccgttgggggtgctgggcggactctgctgttgggaacacttacaacctctttcgaaatatgcgctctacgcacagaacgaggaaatacacttcgccgcctggcctagcttcagcatctaccgtcaagcgacagaagtccttggaccagaagtaaatgtcgcagcttctcggatctacgccgtggaagggcagtgttttgttctcgcttcctgcgcgctcgtctcgccagagatgatcgaaatgctctgcactgacgaaagcaagcacagccttcttcaggccggcggcgggtactcccgcattatcggtcccgatggcagcgacctagcgcgccccttgggcgaaaacgaggaaggtattctctatgccactctggaccctgccgctcgaatctatgcaaagaccgcagctgatccagccgggcactactccagaccagacgtcactcggctgctgatcaatcgcagtgccaatcagccagtcgtagaggttggaagggaaatacctgcatcggcccaaggctttgaagttgaggcggcccccgggtacgaaggcgattga

SEQ ID NO: 48 - protein, 337 aa, Unknown
  Obtained from an environmental sample
VKEAIKVACVQAAPVFLDLDATVDKTVALIEEAARNGARLIAFPETWIPGYPWFLWLDSPAWGMQFVRRYHENSLVLDSPQAKRISEAAQRAGIYVALGYSERVSGTLYMGQWLIDDKGETAGLRRKLKPTHVERTLFGEGDGSSLSTFDTPLGVLGGLCCWEHLQPLSKYALYAQNEEIHFAAWPSFSIYRQATEVLGPEVNVAASRIYAVEGQCFVLASCALVSPEMIEMLCTDESKHSLLQAGGGYSRIIGPDGSDLARPLGENEEGILYATLDPAARIYAKTAADPAGHYSRPDVTRLLINRSANQPVVEVGREIPASAQGFEVEAAPGYEGD

SEQ ID NO: 49 - DNA, 1038 bp, Unknown
  Obtained from an environmental sample
atgaacaaagtcgtggctgctgccgttcagtgcagcccggtgctttactcttgcgccggaactgtaaataaaatttgcgagtggattgcagatttgggcaaacaaggggttgagctggcggtgttcgcggaaaccctggtgccttactacccgtatttttcttttatccaggctccttgtgcgatgggcgcgcaacatttgttgttgatgcaagaatcagtagaggttccttccatctacacgcaacaaattgccgctgcagcaaaagcagcgaagatggtggtgtcagttggtattaacgaacgcgacggcggttctatttataacgcgcaattattatttgatgcgggcggtcagcttgttcagcaccgccgaaaaattacgccgacatttcatgagcgcatggtgtgggggcagggcgatggctccggtttgtgcgcagtggatacggcagttggtcgtgttggttcgctcgcttgctgggaacattacaacccactcgcgcgttacgcattgatggcagatcgcgaacaaattcacgtgagtatgtttcccggttctttggtcggcgaaatttttgccgagcaaattgaagcaactattcgtcaccacgcattggagtccggttgctttgtggtaaatgcgacgggctggttaacgccggaacagcaagctcaaatcgtaaaagatactggtggtcctatcgctgccattagcggtggttgtttcaccgccattgtttcaccggaaggaaaattgctcggcacgccattgcgcagtgattccggggagggtgcctgtatcgccgaactggattttaatctcatcaataagcgtaagcgcatgatggattctgtcggccattacagtcgtcctgaattgctcagtttgctgattgataaaacaccgacaagtcatacacatccgcttaaaaaacctttggctcccagtgaaaaaaatacgccagaggatatcgccactggtttaacactggtcactcccgtttcaaatgcaaaccttttcagcgcaagcaactag

SEQ ID NO: 50 - protein, 345 aa, Unknown
  Obtained from an environmental sample
MNKVVAAAVQCSPVLYSCAGTVNKICEWIADLGKQGVELAVFAETLVPYYPYFSFIQAPCAMGAQHLLLMQESVEVPSIYTQQIAAAAKAAKMVVSVGINERDGGSIYNAQLLFDAGGQLVQHRRKITPTFHERMVWGQGDGSGLCAVDTAVGRVGSLACWEHYNPLARYALMADREQIHVSMFPGSLVGEIFAEQIEATIRHHALESGCFVVNATGWLTPEQQAQIVKDTGGPIAAISGGCFTAIVSPEGKLLGTPLRSDSGEGACIAELDFNLINKRKRMMDSVGHYSRPELLSLLIDKTPTSHTHPLKKPLAPSEKNTPEDIATGLTLVTPVSNANLFSASN

SEQ ID NO: 51 - DNA, 897 bp, Unknown
  Obtained from an environmental sample
gtgaacgtccgcgtcgcggtggtgcaggccacgccggccgtgctcgacgggccggcgtcggtgcggaaggcctgccgcctgatcggcgaggccgcggccggcggcgcccgcctgatcgccctgcccgagggcttcgtgcccatcatgccgcgctcctgctgggggcaccacttcgcgctgatcgcctcgccgaagtcggcggccctgcaccggcgcatctgggagaacgccgtcgacgtcggcggcccgctggcccgcgagctcggcgacgccgcgcgccgcgcggacgcctgggtggccatcggggtgaacgagcgcgacgcccgccggccgggcacgctctggaacacgctgctctggttcgcgcccgacgggagcctggcccggcgccaccgcaagctcgtgcccaccatgcacgagcgcacgttctgggggcagggcgcgggcgacgacctcgaggcgctggccgcggacttcggccgcctgggcggcctgatctgctgggagaacttcatgcccgccgcgcgccggcgcctgcaccgggacggggtcgacttctacctggcccccacggcggacgaccgggacatctgggtcgccgcgatgcgcacgttcgccttcgaggccggcgccttcgtcctctcgccggtgcagtacctgcggaccgccgacttcccggaggacttcccgctgcgcgaggagctcgccgactgccccgaggtccagttcaccggggggagcgtgatctgcgacccgtggggcaacctcctggcggggccggtccacgggggcgaggagatcctctacgccgactgcgatctcgacctcgtcctcgaggcccgacgggtgctcgacacggccggccactacgaccgcccggacctcgcctcggcctga

SEQ ID NO: 52 - protein, 298 aa, Unknown
  Obtained from an environmental sample
VNVRVAVVQATPAVLDGPASVRKACRLIGEAAAGGARLIALPEGFVPIMPRSCWGHHFALIASPKSAALHRRIWENAVDVGGPLARELGDAARRADAWVAIGVNERDARRPGTLWNTLLWFAPDGSLARRHRKLVPTMHERTFWGQGAGDDLEALAADFGRLGGLICWENFMPAARRRLHRDGVDFYLAPTADDRDIWVAAMRTFAFEAGAFVLSPVQYLRTADFPEDFPLREELADCPEVQFTGGSVICDPWGNLLAGPVHGGEEILYADCDLDLVLEARRVLDTAGHYDRPDLASA

SEQ ID NO: 53 - DNA, 954 bp, Unknown
  Obtained from an environmental sample
atggtcaattcaaagagtcagattaaaatcgcggcggtgcaggctgccccggtctttctggaacgggaggcgacgattgacaaagcttgccggttgattgcggaggcaggcgagcagggcgcgaatctggtggtcttccctgagtcattcgtcccggcttatcccgattgggtctgggccgttccggcaggtgaaacaacgctcctgaacacgctctatgccgaactgctggccaatgccgttgaaattccgggtccggcgacagagcggctgagccaggcagccaacctggccggggtttatgtcgcgattggcttgaccgagcggaacatcgaggccagtggggcgagcctgtacaatactttgctctttctcgactcagccggcggcatgttaggcaagcatcgcaaactgatccccaccggcggcgagcgcctggtctgggctcagggtgatggcagcactctggcggtgtacgagactaggtttggaaaaatgggagggttgatttgctgggagaattacatgcccctggcccgttatgccttgtatgcctgggggacgcagatttacatcgcggccacctgggatcgaggcgagccgtggctgtcaacgctgcggcatatcgccgcggaaggccgggttgttgtcgtcggctgtggcatggccctgcgcaaagccgacctgcccgaccgctttgaactcaagcagcgattttaccagaacgccgatgagtggatcaatgtcggcgacagcgcgattgttaaccctgatggtgaattcatcgccgggccgctgcgcgagcaggaaggcatcctctatgctgagattgatctggcccagatgcgcggccccaaatggatgctcgacgtggccggccattacgctcgcccggatgtgtttgaactcatcgttcatcgggaggcgcggcccatgattgcgctaatttcatga

SEQ ID NO: 54 - protein, 317 aa, Unknown
  Obtained from an environmental sample
MVNSKSQIKIAAVQAAPVFLEREATIDKACRLIAEAGEQGANLVVFPESFVPAYPDWVWAVPAGETTLLNTLYAELLANAVEIPGPATERLSQAANLAGVYVAIGLTERNIEASGASLYNTLLFLDSAGGMLGKHRKLIPTGGERLVWAQGDGSTLAVYETRFGKMGGLICWENYMPLARYALYAWGTQIYIAATWDRGEPWLSTLRHIAAEGRVVVVGCGMALRKADLPDRFELKQRFYQNADEWINVGDSAIVNPDGEFIAGPLREQEGILYAEIDLAQMRGPKWMLDVAGHYARPDVFELIVHREARPMIALIS

SEQ ID NO: 55 - DNA, 1017 bp, Unknown
  Obtained from an environmental sample
atgggtatcgaacatccgaagtacaaggtcgccgtggtgcaggcagctcccgcctggctcgatctcgacgcgtcgatcgacaagtcgatcgcgctgatcgaggaggcggcccaaaaaggcgccaagctgatcgcattccccgaggccttcattcccggctatccctggcacatctggatggactcgccggcctgggcgatcggccgcggctttgtgcagcgctattttgacaattcgctcgcctatgacagcccgcaggccgagaagctgcgcgcggcggtgcgcaaggcaaagctcaccgccgtgctcgggctgtccgagcgcgacggcggcagtctctatctggcgcaatggttgatcgggcccgatggcgagaccatcgcaaaacgccgcaagctgcggccgacacatgccgagcgcacggtgtacggcgagggcgacggcagcgatctcgcagtccacaaccgtcccgatatcggccgcctcggcgcgctctgctgctgggagcatttgcagccactgtcgaaatacgcgatgtacgcgcagaacgagcaggtgcatgtcgcggcctggccgagcttttcgctctacgatccctttgcggtggcgctcggcgccgaggtgaacaacgcggcctcgcgcgtctatgcagtcgaaggctcctgcttcgtgctggcgccatgcgccaccgtctcgcaggccatgatcgacgagctctgcgaccgaccggacaagcatacgctgctgcatgtcggcggcggttttgccgcgatctatggtcctgacggcagccagatcggcgacaagctcgcgcccgaccaggaagggctgttgatcgcggagatcgaccttggggccattggcgtcgccaagaacgcggccgatcccgccgggcattattcgcggcccgacgtgacgcggctcctgctcaacaagaaaccgtacaagcgcgtcgagcagttctcgccaccggccgaggcggtcgagcccacagatatcgcagcggcggcaagctga

SEQ ID NO: 56 - protein, 338 aa, Unknown
  Obtained from an environmental sample
MGIEHPKYKVAVVQAAPAWLDLDASIDKSIALIEEAAQKGAKLIAFPEAFIPGYPWHIWMDSPAWAIGRGFVQRYFDNSLAYDSPQAEKLRAAVRKAKLTAVLGLSERDGGSLYLAQWLIGPDGETIAKRRKLRPTHAERTVYGEGDGSDLAVHNRPDIGRLGALCCWEHLQPLSKYAMYAQNEQVHVAAWPSFSLYDPFAVALGAEVNNAASRVYAVEGSCFVLAPCATVSQAMIDELCDRPDKHTLLHVGGGFAAIYGPDGSQIGDKLAPDQEGLLIAEIDLGAIGVAKNAADPAGHYSRPDVTRLLLNKKPYKRVEQFSPPAEAVEPTDIAAAAS

SEQ ID NO: 57 - DNA, 1014 bp, Unknown
  Obtained from an environmental sample
gtgaaagaagcaatcaaagtagcctgtgtgcaagcagctccagtctttctcgacctggacgccacagtggacaagaccgtcgccctgattgaggaggcagcccgtaacggcgcacgcctaatcgcctttccagagacctggattccaggctacccatggttcctttggctggactcaccagcctgggggatgcaattcgtgcgccgataccacgagaactcactggtcctcgacagccctcaggccaagcgcatcagtgaggccgcccagcgcgccggtatatacgtcgcgctagggtacagcgaacgcgtgagcggaaccctctacatggggcagtggctcattgacgataagggcgaaacagctgggctgcgccgaaagctgaaaccaacccatgtagagcgaaccctcttcggtgaaggcgacggatcatccctttccactttcgacacaccgttgggggtgctgggcggactctgctgttgggaacacttacaacctctttcgaaatatgcgctctacgcacagaacgaggaaatacacttcgccgcctggcctagcttcagcatctaccgtcaagcgacagaagtccttggaccagaagtaaatgtcgcagcttctcggatctacgccgtggaagggcagtgttttgttctcgcttcctgcgcgctcgtctcgccagagatgatcgaaatgctctgcactgacgaaagcaagcacagccttcttcaggccggcggcgggtactcccgcattatcggtcccgatggcagcgacctagcgcgccccttgggcgaaaacgaggaaggtattctctatgccactctggaccctgccgctcgaatctatgcaaagaccgcagctgatccagccgggcactactccagaccagacgtcactcggctgctgatcaatcgcagtgccaatcagccagtcgtagaggttggacgggaaatacctgcatcggcccaaggctttgaagttgaggcggcccccgggtacggaggcgattga

SEQ ID NO: 58 - protein, 337 aa, Unknown
  Obtained from an environmental sample
VKEAIKVACVQAAPVFLDLDATVDKTVALIEEAARNGARLIAFPETWIPGYPWFLWLDSPAWGMQFVRRYHENSLVLDSPQAKRISEAAQRAGIYVALGYSERVSGTLYMGQWLIDDKGETAGLRRKLKPTHVERTLFGEGDGSSLSTFDTPLGVLGGLCCWEHLQPLSKYALYAQNEEIHFAAWPSFSIYRQATEVLGPEVNVAASRIYAVEGQCFVLASCALVSPEMIEMLCTDESKHSLLQAGGGYSRIIGPDGSDLARPLGENEEGILYATLDPAARIYAKTAADPAGHYSRPDVTRLLINRSANQPVVEVGREIPASAQGFEVEAAPGYGGD

SEQ ID NO: 59 - DNA, 987 bp, Unknown
  Obtained from an environmental sample
atgcgagataggaatttcaaactggcggccattcaggcggagccggttttctttaatcgccgggcctcgacggaaaaggcctgcagattgatcaaagaagcgggcgcgatgggcgccgatatcgcgggattcagcgagacctggcttcccgggtatcccttttttatctggggcgcaagcgccgatccatccctgctctggaaggcttctgcggaatacctggccaatgccgttcaaatacccggtcccgagacggatcaattatgcgaggcggcgaaaaaggccggcatcgatgtggcgatcggagtggttgaactcgacgagtttacgaagggaacggcttactgcacgctgctcttcatcggcaaagaagggaagatcctgggaaagcaccgcaaactcaagccgacgcaccgggagcgcacggtatggggagagggcgatgcgacgggactcagtgtccatgagcgtccttacgggcggatcagcggcctgaactgctgggagcataatatggtcctgcccggctatgtcctgatgtctcagggcacgcacattcatatcgcggcctggccgggttcggaagggaaagcacctcccgcgccgtctccgatgtgggagcgccagcttctgctctcccgcgctttcgcttcgcaatccgccgcatacgtgattctggtcggaggactcctgaacccgcagaatattccggcgccctacgatgaacttgccgtcaagtaccggggagacagtttcatcatcgatccgcgcggggagatcatcgccgggccggccaagggggaaaccattctcatcgccgaaggctcgatggaacaggtcctcgcggcaaagtccgccttcgatgtcgcgggacattattcccgccccgacgtctttcaactctgcgtcaaccgcaaaccgtaccggcgtgtaagggaaacttcggagcaggaccaacccgcttctgaaagagaatcggaatcgtaa

SEQ ID NO: 60 - protein, 328 aa, Unknown
  Obtained from an environmental sample
MRDRNFKLAAIQAEPVFFNRRASTEKACRLIKEAGAMGADIAGFSETWLPGYPFFIWGASADPSLLWKASAEYLANAVQIPGPETDQLCEAAKKAGIDVAIGVVELDEFTKGTAYCTLLFIGKEGKILGKHRKLKPTHRERTVWGEGDATGLSVHERPYGRISGLNCWEHNMVLPGYVLMSQGTHIHIAAWPGSEGKAPPAPSPMWERQLLLSRAFASQSAAYVILVGGLLNPQNIPAPYDELAVKYRGDSFIIDPRGEIIAGPAKGETILIAEGSMEQVLAAKSAFDVAGHYSRPDVFQLCVNRKPYRRVRETSEQDQPASERESES

SEQ ID NO: 61 - DNA, 966 bp, Unknown
  Obtained from an environmental sample
atgactcgatcttacccgaatgacacactcacggttgggcttgcgcaaattgctccagtctggttggatcgtacagggacaatttcaaagatattagctcaagtccatgcggcaaatgaagcgggctgtcatcttgtcgcgtttggcgaaggtctcctccccggatatccgttttggattgagcgaacaaatggtgcagtcttcaactcgcccacgcagaaagaaattcacgcgcattatctggatcaggctgtccagatcgaagcaggtcatcttgaggcgctttgcgaagcagccaaggaatatgagatcgcaattgtcctgggatgcattgaacgtccgcaagatcgtggagggcacagtctgtatgcaagccttgtatatattgattcagacggcatcatccaatctgtgcatcgaaagttaatgccaacatatgaagaacggctcacctggtcgccaggtgacggacatggattacgggtgcacaaattaggtgcctttacggttggcggcctcaactgttgggaaaactggatgcctttggcacgcgcggccatgtatggtcaaggcgaggatttgcatattgccatttggcccggcggctcccacaatacgcaagacattacacgctttattgcactagaatcgcgttcctatgttttatctgtgtcaggtttaatgcgctcaggcgattttccaaaagagaccccacatcttgcatccatcctggctaaaggtgaggatattcttgccaacggtggttcatgtatcgccggtcctgacggcaaatggatcgttgagccgcttgtaggagaagagaagttaattgttgcaacgattgatcattgtcgtgtgcgcgaagagcgtcaaaattttgatccttcaggacattacagcaggccagatgtattgcaactgaaaataaacaggcaacgccagagtacaatctcgtttggagagtaa

SEQ ID NO: 62 - protein, 321 aa, Unknown
  Obtained from an environmental sample
MTRSYPNDTLTVGLAQIAPVWLDRTGTISKILAQVHAANEAGCHLVAFGEGLLPGYPFWIERTNGAVFNSPTQKEIHAHYLDQAVQIEAGHLEALCEAAKEYEIAIVLGCIERPQDRGGHSLYASLVYIDSDGIIQSVHRKLMPTYEERLTWSPGDGHGLRVHKLGAFTVGGLNCWENWMPLARAAMYGQGEDLHIAIWPGGSHNTQDITRFIALESRSYVLSVSGLMRSGDFPKETPHLASILAKGEDILANGGSCIAGPDGKWIVEPLVGEEKLIVATIDHCRVREERQNFDPSGHYSRPDVLQLKINRQRQSTISFGE

SEQ ID NO: 63 - DNA, 978 bp, Unknown
  Obtained from an environmental sample
atgcaagatagagtaccgattgtacgagctgcggctatccaggctgaacccatagtccttgattgtgacgcgaccgtggaaaaagcctgccgattgatcggtgaagcagcagaaaatggtgcaaacctgatcgtgtttcccgaagccttcattcccgtttatcccaatgcggcgatctggggtcgaggtctggccacttttggcggacagcgccagaaatacgtatggacgcgactatggaacaattcggtggaaatccctggtccggccaccgacaggctggcaaaggcagcacacgaggctcgagccaccgttgtcatgggattgaatgagcgcgcggtcgataacaacacgctttacaacaccctgctatttattgggccagacggtcgcttgctgggcaagcaccgtaagctcatgcccaccaatcacgaacggatgatctggggtatgggagatgggagcaccctgcgggtttttgatacaccctgtggaaaagtaggcggtctcatctgctgggaaaactacatgcctctggcgcgttatgcactctatggacagggcgaacaaatccatgtcgcgccgactgcgcacgatggtgagatcactctggtcaatgcacgcaataccgcctatgagggacgcttattcgtcatctccgtgtgcatgatccttcgcaagtccagctttccccatgattttgagctgggcgaggaattggcggaggcagatgacttcataaaatcaggcggcagcgcgatcgttgggccagatggcgaggtgctggcgggtccattgtggaatgaagagaatatactgtatgccgatcttgacttgaatcgaattgtggatgagagacgagtatttgatgtgacgggccattattcacgtccagatgttctacgactgcactttaatgcttcccctcagaaaactattgaaagatatgagcaacctctcgatccgtctgagggttaa

SEQ ID NO: 64 - protein, 325 aa, Unknown
  Obtained from an environmental sample
MQDRVPIVRAAAIQAEPIVLDCDATVEKACRLIGEAAENGANLIVFPEAFIPVYPNAAIWGRGLATFGGQRQKYVWTRLWNNSVEIPGPATDRLAKAAHEARATVVMGLNERAVDNNTLYNTLLFIGPDGRLLGKHRKLMPTNHERMIWGMGDGSTLRVFDTPCGKVGGLICWENYMPLARYALYGQGEQIHVAPTAHDGEITLVNARNTAYEGRLFVISVCMILRKSSFPHDFELGEELAEADDFIKSGGSAIVGPDGEVLAGPLWNEENILYADLDLNRIVDERRVFDVTGHYSRPDVLRLHFNASPQKTIERYEQPLDPSEG

SEQ ID NO: 65 - DNA, 1002 bp, Unknown
  Obtained from an environmental sample
atgccgacccccacttcaaaattcaaaatcggcgccgtgcaggcatcgccggtttttctggaccgggaagccactgcgcaaaaagcctgcaaattgattgccgaagcgggagggcagggcgcgcggctgatcgttttcccggagtctttcattcccacctatcctgattgggtctgggcggtcccgccgggaagaggaaaagtgttaagcgaactttacgccgagctgctggccaatgccgtggaagtccccgggccggtcaccgatcagctgggtgaagcagcccaaaaaacgggcgcctatgtcgtcatgggcgtcacggaaaaggacaccgacgcaagcggcgcgagcctttacaacacgctcctctatttcaaccccgcgggggacctcctgggaaaacaccggaagcttgttcctaccggcggggagcggctggtctgggcgcagggcgacggcagcaccctggaagtgtacgacactcccctgggaaaaatcggaggcctcatctgctgggaaaactacatgcccctcgcccggtacacgatgtatgcctgggggacccagatttatatcgcggccacatgggaccagggggagacgtggcttgccaccctgcggcatatcgctaaggaaggacgggtgtacgtcatcggctgctgcatcgcgctgcggcgggacgacatccccgaccggctggaatacaagaagaagttctactcggggtcgcgggaatggatcaatatgggggacagcgccatcgtgaacccggaaggcgaattcattgccggccccgtgcggatgaaggaggagatcctgtatgccgaggtggaccccctcctgatggcgggatcgaaatggatgctcgacgtcgcggggcattacgcgcgccccgacgtctttgaactcatcgtccaccgccagccccacccgatgatccgggtaatcgagaaagagggaggggccggaagaaccggggacgagaagaaggaaaatgagtga

SEQ ID NO: 66 - protein, 333 aa, Unknown
  Obtained from an environmental sample
MPTPTSKFKIGAVQASPVFLDREATAQKACKLIAEAGGQGARLIVFPESFIPTYPDWVWAVPPGRGKVLSELYAELLANAVEVPGPVTDQLGEAAQKTGAYVVMGVTEKDTDASGASLYNTLLYFNPAGDLLGKHRKLVPTGGERLVWAQGDGSTLEVYDTPLGKIGGLICWENYMPLARYTMYAWGTQIYIAATWDQGETWLATLRHIAKEGRVYVIGCCIALRRDDIPDRLEYKKKFYSGSREWINMGDSAIVNPEGEFIAGPVRMKEEILYAEVDPLLMAGSKWMLDVAGHYARPDVFELIVHRQPHPMIRVIEKEGGAGRTGDEKKENE

SEQ ID NO: 67 - DNA, 936 bp, Unknown
  Obtained from an environmental sample
atgccccgtgtggcggtggtccagcgcccgccggtgtttctcgaccgcgccgcgaccctcgagaacgccgtggcttcgctcgccgaggccgcgtcgaacggggctcgcctcgcggtctttccggaagccctggttcccggctatccggcgtggatgtggcggctgcggcccgggcccgacatggcgctcaccgagcggattcacgcgcgcttgcgggcgaactcggtgagcctcgccgccgacgagctcgcgccgctgcgcgaggcggcccggcgccacgagctcaccgtagtgtgcggcctgcacgagcgcgacgaggcgctcggcggcggcacgctctataacaccgtcgtcacgatcggcgccgacggcgcggtgctcaaccgccaccggaagctgatgcccaccaaccccgagcgcatggtctggggctgcggcgatgccagcgggctcaggacggtccccacccagtgcgggcgcgtcggcgccctgatctgctgggaaagctacatgccgcttgcacgctacgcgctgtacgcccagggaatcgacctctacgtcacgccgacctacgacagcggcgagcgggcggttgcgaccatgcagcacattgcccgcgaaggcggctgctgggtggtgagctgcggctcggcgtttcaggcgcgcgacgtcccggacgcgtttccggggaagagcgagcttttccgcgacaacgacgagtggatcaacccgggcgactcggtcgtggtcgcgccgggcggcaaggtcgtcgccgggccgctgcacaaagaacgcgcgatcctgtacgccgagatcgacctcgagcgggtcggcgtggcgcgccgcagcctggacgtggtcggccattatgcgcggcccgacctcttcgacctgcacgtgaacgcccgcccgcaaagcgtggttgaattgcgctga

SEQ ID NO: 68 - protein, 311 aa, Unknown
  Obtained from an environmental sample
MPRVAVVQRPPVFLDRAATLENAVASLAEAASNGARLAVFPEALVPGYPAWMWRLRPGPDMALTERIHARLRANSVSLAADELAPLREAARRHELTVVCGLHERDEALGGGTLYNTVVTIGADGAVLNRHRKLMPTNPERMVWGCGDASGLRTVPTQCGRVGALICWESYMPLARYALYAQGIDLYVTPTYDSGERAVATMQHIAREGGCWVVSCGSAFQARDVPDAFPGKSELFRDNDEWINPGDSVVVAPGGKVVAGPLHKERAILYAEIDLERVGVARRSLDVVGHYARPDLFDLHVNARPQSVVELR

SEQ ID NO: 69 - DNA, 939 bp, Unknown
  Obtained from an environmental sample
gtgaccgagtttcggacggtgcgggtcgcagcggtgcaggcgacgccggtgaccctcgacgccgatgcctcggtcgagaaggcgatcgggctgatcggcgaggcggtggccggtggagcgcagctcgtcgtgctgcccgaggccttcgtgtcgctctacccgtcgaacgcgtgggcgcgagcggccgccggattcggcggcttcgacgagctctgggagcggatgtgggccagctcgctcgacgtcccgggcccgctggtcgaccggctggtcgatgcgtgccgcaggcatgacgtggtatgcgtgatcggcgtgaacgagcgcgaaagcgaaaggccggggtcgctttacaacacgatgctgaccctcggcccgtcgggcctcctgcaccggcaccgcaagctcatgccgacgcaccacgagcggctgttccatgggatcggcgacggtcaagacctcggcgttgtggagaccgacgcgggacggatcgggggactgatctgctgggagaaccgaatgccgctcgcgcgctacgcggtctaccagggtggaccgcagatctgggtcgcgccgacggccgatgactccgacggctggctcgcgagcatgcgccacatcgcgatcgagtcgggcgcgttcgtcgtgtcggtgccgcagttcatcccggcgtccgcgttccccgacgatttccccgtcgagctaccgccgggcaaggaggtgttcggccgcggcggtgcggcgatcgtcgagccgacctggggcgaggtaatcgccgggccgctctacgatcgggaggggatcgtgttcgccgactgtgacctgcgacgcggcttgcatgccaagcgctggttcgactccgtcggccattacagccgcgcggaggtgctcgatggcggcgtcgagcgcgtcccggcgccggtggacggcgaatcgccgtga

SEQ ID NO: 70 - protein, 312 aa, Unknown
  Obtained from an environmental sample
VTEFRTVRVAAVQATPVTLDADASVEKAIGLIGEAVAGGAQLVVLPEAFVSLYPSNAWARAAAGFGGFDELWERMWASSLDVPGPLVDRLVDACRRHDVVCVIGVNERESERPGSLYNTMLTLGPSGLLHRHRKLMPTHHERLFHGIGDGQDLGVVETDAGRIGGLICWENRMPLARYAVYQGGPQIWVAPTADDSDGWLASMRHIAIESGAFVVSVPQFIPASAFPDDFPVELPPGKEVFGRGGAAIVEPTWGEVIAGPLYDREGIVFADCDLRRGLHAKRWFDSVGHYSRAEVLDGGVERVPAPVDGESP

SEQ ID NO: 71 - DNA, 966 bp, Unknown
  Obtained from an environmental sample
atgccaaacgagaacaccaacgccacattcaaagttgccgctgtgcaggcttcgcctgtgtttcttgatcgtgccgcaacaatcgacaaggcttgcgatttgatcgccgctgctggcggtgaaggggcacgcttgattgtctttccagaagcattcatcccgtcttatcctgattgggtatgggcaattccttcgggtgaagagggcgtactcaatgagttgtacgcagatctgctatccaactcggtcacgattcccagtgactcgacggacaaactgtgcagagcagccaggcttgctaatgcctacgtggtgatgggtatgagcgaacgcaatgctgaggcaagcggcgcgagcatgtataacacgctattgtatattgatgcacagggggagattctgggcaagcatcggaagttggtgccaacgggcggcgagcggctagtctgggcgcagggcgatggcagtacactgcaggtctatgatactcccttagggaaactcggtggcttaatttgctgggagaattatatgccactggcccgctataccatgtatgcctggggcacacaaatctatgtcgcggcaacgtgggatcggggtcagccctggctctctactttacgccacattgccaaagaaggcagggtgtatgtgattggttgttgtatcgcgatgcgtaaagacgatatcccagaccattatacaatgaaacagaagttttactcagatgcagatgagtggattaatattggcgatagtgcgattgttaatcccgaagggcaatttatcgctggaccggtgcgcaagcaggaagagattctctatgcggagattgatccgcgcatggtccaagggccgaagtggatgctcgacgtggcgggacattatgccaggccggatgtgttcgaactgattgtccacacggatattcgaaggatgatcaaatcggaaaagaattcataa

SEQ ID NO: 72 - protein, 321 aa, Unknown
  Obtained from an environmental sample
MPNENTNATFKVAAVQASPVFLDRAATIDKACDLIAAAGGEGARLIVFPEAFIPSYPDWVWAIPSGEEGVLNELYADLLSNSVTIPSDSTDKLCRAARLANAYVVMGMSERNAEASGASMYNTLLYIDAQGEILGKHRKLVPTGGERLVWAQGDGSTLQVYDTPLGKLGGLICWENYMPLARYTMYAWGTQIYVAATWDRGQPWLSTLRHIAKEGRVYVIGCCIAMRKDDIPDHYTMKQKFYSDADEWINIGDSAIVNPEGQFIAGPVRKQEEILYAEIDPRMVQGPKWMLDVAGHYARPDVFELIVHTDIRRMIKSEKNS

SEQ ID NO: 73 - DNA, 1035 bp, Unknown
  Obtained from an environmental sample
atgacagcaatagactcaacgtttaaagtcgccgccgttcaggctgcgccggtcttcctcaatcgcgacgcaaccgtggagaaggcgtgccggctgatcaagtccgcggcagagggaggcgcgcgtctgatcgttttcccggaagcgttcataccggcctacccggactgggtgtggacggtccctgccggtgagcaaggcctgctcaacgacctctacggccaactcgtcgaccagtccgtgacgattcccagcgacatcaccaccgagttatgtaacgcggcacgggcagcaaacgcctatgtcgtgattggtgtcaacgagcgcaacgcggaggcaagcaatggaagcctctacaactcgctcctctacatcgacgcaaacggcaaaattctcggtaagcaccgcaagctcgttcccacaggcggagaacggctcgtgtgggcgcagggcgatggcagcacgctcgaagcctacgacacggagctgggcaaactcggcggtctcatttgctgggagaactatatgccgctggcacgctacgcgatgtacgcatggggagtgcagctctatgtcgccgcgacctgggaccgtggcggcccctggactgccacgctgcgtcatgtcgccaaggaaggtcagatgtacgtcatcgggtgctgccaggccctgcacaaggatgacctgccggagctagacgggctgaaggagaagtactacgccaacgcacgagagtggatcaatgttggcgacagcgctattgtcggcccggacggacaattccttgtcgagcccgtccgaatgcgggaagacatcctctacgccgaggtggacactcgcaacttccgcggcccgaagtggatgttcgacgcggctggacactacgcgcgtcccgacattttccaactcacagtgaaccgcgagcagcggccgatggtccgcgtcgtcggtgacagcagtgaccagaaggagcggccgctcccggacgacggacggctctggtacgcctacagcaccaatcagcaccacgactga

SEQ ID NO: 74 - protein, 344 aa, Unknown
  Obtained from an environmental sample
MTAIDSTFKVAAVQAAPVFLNRDATVEKACRLIKSAAEGGARLIVFPEAFIPAYPDWVWTVPAGEQGLLNDLYGQLVDQSVTIPSDITTELCNAARAANAYVVIGVNERNAEASNGSLYNSLLYIDANGKILGKHRKLVPTGGERLVWAQGDGSTLEAYDTELGKLGGLICWENYMPLARYAMYAWGVQLYVAATWDRGGPWTATLRHVAKEGQMYVIGCCQALHKDDLPELDGLKEKYYANAREWINVGDSAIVGPDGQFLVEPVRMREDILYAEVDTRNFRGPKWMFDAAGHYARPDIFQLTVNREQRPMVRVVGDSSDQKERPLPDDGRLWYAYSTNQHHD

SEQ ID NO: 75 - DNA, 1125 bp, Unknown
  Obtained from an environmental sample
atgagcaccattgttaaagccgctgcggttcaaatcagcccagtcctctacagccgcgaggggacagtcgcaaaagttgtgcggaagatccacgaacttggccaaaagggggtgcggttcgccacgttcccggagaccgtggttccctactatccatatttttccgccgtccagacccccattcaactattgtccggaaccgagtacctgaagttgctcgaccaaggcgtgaccgtgccgtccacgactaccgacgcaatcggggaggctgcccggaacgccggcatggttgtatctatcggcgtgaatgagcgtgacggcgggaccctgtacaacgcgcagttgctcttcgatgcggatgggaccttgattcagcgtcgccgcaagatcactcctacgcattacgagcgcatgatctggggccagggagatggttcgggtttgcgggccgtcaagagccaggttggtcgtattggccaacttgcatgctttgagcacaacaacccactggcgcgttacgcgatgatggccgatggcgagcaaatccattcggccatgtatccaggttccgcgttcggcgaggggttcgcggaaaagatggaaatcaatatccgccagcatgcgttggagtccgggtgcttcgttgtgaatgcaacggcctggcttgacgccagccagcaggcacaaatcatgaatgacacgggttgccaaatcggtccgatctcgggcggttgctttaccacgatcgtaacacccgacggcacgtttctgggcgaacctctccggtcgggtgagggcgaggtcatcgccgatctcgatttcaagctgatcgacaaacgcaagatgttgatggactcgcgcggccactacagtcgcccggaattgctcagtctgctgatcgaccgcacccccaccgcgcacattcatgagcgaggtgcgccgcagacgtcaggcgctgtgcaagaggcgacgaaagtgggttcacacgcgccgctcctgcgtgacggacaatgggatcagctcaatgcgggagcgggccgacatacagggaatggagaagcacagatagaaatcatggccgcggcccactcgggcacccgtggaattgaagcgaagggagcctaa

SEQ ID NO: 76 - protein, 374 aa, Unknown
  Obtained from an environmental sample
MSTIVKAAAVQISPVLYSREGTVAKVVRKIHELGQKGVRFATFPETVVPYYPYFSAVQTPIQLLSGTEYLKLLDQGVTVPSTTTDAIGEAARNAGMVVSIGVNERDGGTLYNAQLLFDADGTLIQRRRKITPTHYERMIWGQGDGSGLRAVKSQVGRIGQLACFEHNNPLARYAMMADGEQIHSAMYPGSAFGEGFAEKMEINIRQHALESGCFVVNATAWLDASQQAQIMNDTGCQIGPISGGCFTTIVTPDGTFLGEPLRSGEGEVIADLDFKLIDKRKMLMDSRGHYSRPELLSLLIDRTPTAHIHERGAPQTSGAVQEATKVGSHAPLLRDGQWDQLNAGAGRHTGNGEAQIEIMAAAHSGTRGIEAKGA

SEQ ID NO: 77 - DNA, 1056 bp, Unknown
  Obtained from an environmental sample
atgccaacccccagcgatcatttcaaaatcgccgctgttcaggcctcgcccgtgtttctggaccgggaggccactgtggaaaaggcctgccggttgatcgccgaagccgcaaagcagggcgtccgcctcatcgtctttccggaatcgttcatcccgacctacccggactgggtatgggccgttcccccgggaagggaaagaatcctgaaccagctgtattctgaattcctggccaatgccgtcgatgttcccggcgcggcgaccgaacaacttgcccaggctgcacgaatggccggcgcctatgtgattatgggcgtcaccgaaagagacacctcggccagcggggccagcctctacaacaccctgctctacttcagccccgaaggcatcctaatgggcaaacaccggaagctggttcccacggggggcgaacggctggtctgggcctacggagacggcagcacgctggaggtctacgacactccgctgggaaagatcggcgggctgatctgctgggagaactacatgcccctggcccggtacacgatgtacgcctggggcacccagatttacatcgccgccacctgggaccgcggggaaccgtggctctccaccctgcggcatatcgcaaaggaaggaagggtctacgtcatcgggtgctgcatcgccctgcgccagggggatatcccggaccggttcgagtacaagggaaaattttattccgggtcccgggagtggatcaatgagggcgacagcgccatcgtgaacccggacggggaattcatcgccgggccggtgcggacgaaggaggagatcctgtatgccgagatagacccccggcagatgcggggccccaagtggatgctcgatgtggccggtcattacgcccggccggatatcttcgagctcatcgtccaccggaatccccacccgatgatcaaaatcgccgaagacaggggcacggggatcgcctcaagtttgattcgcccccgccctaaccttcccccatcaagggggaggaaatcggcaagaagcaaacgcaagcccaaaaaatga

SEQ ID NO: 78 - protein, 351 aa, Unknown
  Obtained from an environmental sample
MPTPSDHFKIAAVQASPVFLDREATVEKACRLIAEAAKQGVRLIVFPESFIPTYPDWVWAVPPGRERILNQLYSEFLANAVDVPGAATEQLAQAARMAGAYVIMGVTERDTSASGASLYNTLLYFSPEGILMGKHRKLVPTGGERLVWAYGDGSTLEVYDTPLGKIGGLICWENYMPLARYTMYAWGTQIYIAATWDRGEPWLSTLRHIAKEGRVYVIGCCIALRQGDIPDRFEYKGKFYSGSREWINEGDSAIVNPDGEFIAGPVRTKEEILYAEIDPRQMRGPKWMLDVAGHYARPDIFELIVHRNPHPMIKIAEDRGTGIASSLIRPRPNLPPSRGRKSARSKRKPKK

SEQ ID NO: 79 - DNA, 990 bp, Unknown
  Obtained from an environmental sample
atgacgaagaaaagcggccgcgattcgtttcgggtcgctgcggtccaggcctcgtccgtctacctggatcgggaacggagcatcgagaaagcgtgccggctgatcgacgacgcgggacgaaacgacgccgacctcgtcgtgttccccgaagccttcgtgcccggatacccactgtgggtgtggctcgttccgccggggcgcaccgcagacttgcgctccgcttatgcgacgctccacgccaacgcgatcagcattccggacgactccaccgatcggctgtgcgccgccgcaaaagacgccggcgtcgccgtcgcgatcggcgtcaacgaacgcaacaccgaagcgagcggcatgagcctgttcaacacgctgctctatatcggagcggacggccggattctcggaaaacaccggaagctggtaccgaccggcggcgaacggctcgtctgggcatctggcgacggcagcgacctcgaggtctactcgctgccgttcggtcgcgtaagcggactgatctgctgggagcactacatgccgctcgcccggtatgcgctcgccgcgtggggcgaacaggtgcacgtcgctccaacctgggatcgtggcgagccgtggctgtccacgctaaggcacatcgcgaaggaaggccgcgttctcgtcgtcggctgctgtcaagccgtgcgcaaggacgacatccctgacacgctcgcgttcaagtccaaatacctcgcagacgtggacggctggatcaacccaggtggcagcgtcatcatcaatcctgacggcaaggtcgtcgcgggaccggcgatggaaaccgaaactgtactgtacgcggaccttcgcaccgagcagctcgtcggaccgcgctggcagctcgacgtcggcggacattacgctcgtccggacgtcttcgagctcgtcgtccatcggcatccgaagccgttgattcggacagcgaccggtgtcaggcgccgcaagcgtgcacgtcgctaa

SEQ ID NO: 80 - protein, 329 aa, Unknown
  Obtained from an environmental sample
MTKKSGRDSFRVAAVQASSVYLDRERSIEKACRLIDDAGRNDADLVVFPEAFVPGYPLWVWLVPPGRTADLRSAYATLHANAISIPDDSTDRLCAAAKDAGVAVAIGVNERNTEASGMSLFNTLLYIGADGRILGKHRKLVPTGGERLVWASGDGSDLEVYSLPFGRVSGLICWEHYMPLARYALAAWGEQVHVAPTWDRGEPWLSTLRHIAKEGRVLVVGCCQAVRKDDIPDTLAFKSKYLADVDGWINPGGSVIINPDGKVVAGPAMETETVLYADLRTEQLVGPRWQLDVGGHYARPDVFELVVHRHPKPLIRTATGVRRRKRARR

SEQ ID NO: 81 - DNA, 993 bp, Unknown
  Obtained from an environmental sample
atgaaagtcgtcaaagccgccgctgtccagttcagcccggtgctctatagccgcgaagcgaccgtcgccaaggtcgtccggaaaatccacgagctcggtcagaaaggcgtgcagttcgccacctttcctgaaacggtcgtgccttattacccttacttcgcggccgtccagacgggcatcgagctcttgtcgggcaccgaacatctgcgcctgctcgaacaggccgtgactgtgccctccgctgcgaccgatgcaatcggcgaagccgcgcgacaggccggcatggtcgtgtccatcggcgtcaatgagcgtgacggcggcacgctttacaacacgcaactgctcttcgatgccgacggtacgctgatccagcgccgccgcaagatcacgccgacccatttcgaacgcatgatctgggggcagggagatggctcgggcttgcgtgcagtcgacagcgcagtcggccgcatcggccagctcgcatgcttcgagcacaacaacccgcttgcacgttacgcaatgatcgccgacggcgagcagatccattcagcgatgtaccctggctcggcctttggcgagggcttcgcccagcgtatggagatcaacatccgccagcatgcgctcgagtccgccgctttcgtcgtcaacgcaacggcgtggcttgacgccgaccagcaggcgcaaatcatgaaggacaccggttgtggaatcggtccgatctcgggcggctgcttcaccacgatcgtttctcctgacggtatgctgatggccgatccgcttcgctcgggcgaaggcgaagtgattgtcgatctcgacttcacgcagatcgaccgccgcaagatgctgatggactcggccggccactacaaccgccctgaactgctgagtctgatgatcgaccgtacgccggctgcgcatgttcacgaacgcgcttcgcgcccgatgaccgtcgacgaccagagttccggcgatctgcgcacccaggttgcatga

SEQ ID NO: 82 - protein, 330 aa, Unknown
  Obtained from an environmental sample
MKVVKAAAVQFSPVLYSREATVAKVVRKIHELGQKGVQFATFPETVVPYYPYFAAVQTGIELLSGTEHLRLLEQAVTVPSAATDAIGEAARQAGMVVSIGVNERDGGTLYNTQLLFDADGTLIQRRRKITPTHFERMIWGQGDGSGLRAVDSAVGRIGQLACFEHNNPLARYAMIADGEQIHSAMYPGSAFGEGFAQRMEINIRQHALESAAFVVNATAWLDADQQAQIMKDTGCGIGPISGGCFTTIVSPDGMLMADPLRSGEGEVIVDLDFTQIDRRKMLMDSAGHYNRPELLSLMIDRTPAAHVHERASRPMTVDDQSSGDLRTQVA

SEQ ID NO: 83 - DNA, 1071 bp, Unknown
  Obtained from an environmental sample
atgatgagttcagcccgtgtaataaaactcgccgcagcacagctttcacctgtgctgccgggggagtccacaaatagccgcgacggcaccattgccaaagtcgtcgcggcgattgcggaggctgcgcgcgccggcgcgcagctgatcgtgtttcccgaaacggtggtgccgtattacccgtatttctcgttcattacgccggcggtgacgatgggggcggagcatttgcgcttgtacgatcagtctgtcgtggtgccgagcgccgccactgatactgttgccgccgctgcaaaaaaacacagcatggtggtcgtgctcggtattaacgaacgcgatcacggcacgctctacaacgcgcaattaattttcgatgcgagcggcgaattattattaaaacgccgaaaaattaccccgacctatcacgagcgcatggtgtggggtcagggcgacggcagcggtttgaaaaccgtcgacaccgcgatcggccgtgtcggtgcgctcgcctgctgggaacattacaacccattggcgcgttacagcctgatggcccagcacgaagaaattcattgcagtcaatttccggggtcattggtcgggccaattttcgccgagcaaatggaagtgacaatgcgccaccacgcgctcgaatccggttgcttcgtcgttaatgcaacggcgtggttatcggaagcgcaaattcaatcgatcagcagcgatcccgcgatgcaaaaagcactgcgcggcggttgctacaccgcaattatttcgcccgaaggcaaacatctgtgcgagccgctacgcgaaggtgaaggtttgatttttgccgaagccgatatggcgctcattaccaaacgcaaacgcatgatggattcggttggtcattacgcgcgacccgaattgctgtcgctgttaatcgaccatcgcgccaccacaccattgcatagcgtcaccgcgagtgatgccgccgccgtaaaaaatactcggagttccgctcatgaatcagccgatagtgaaaccatccgcgagtcagttaataacggaactccaatcgcacggcttgcgcctagttga

SEQ ID NO: 84 - protein, 356 aa, Unknown
  Obtained from an environmental sample
MMSSARVIKLAAAQLSPVLPGESTNSRDGTIAKVVAAIAEAARAGAQLIVFPETVVPYYPYFSFITPAVTMGAEHLRLYDQSVVVPSAATDTVAAAAKKHSMVVVLGINERDHGTLYNAQLIFDASGELLLKRRKITPTYHERMVWGQGDGSGLKTVDTAIGRVGALACWEHYNPLARYSLMAQHEEIHCSQFPGSLVGPIFAEQMEVTMRHHALESGCFVVNATAWLSEAQIQSISSDPAMQKALRGGCYTAIISPEGKHLCEPLREGEGLIFAEADMALITKRKRMMDSVGHYARPELLSLLIDHRATTPLHSVTASDAAAVKNTRSSAHESADSETIRESVNNGTPIARLAPS

SEQ ID NO: 85 - DNA, 1014 bp, Unknown
  Obtained from an environmental sample
atgggtctggttcatcagaaatacaaggttgcggtggttcaggcggcgccggtctttctcgacctcgatgcgacggtggacaagacgatcgccctgatcgagcaggccgcagcacagggcgcgaagctgatcgcgtttcccgagaccttcattcccggatatccgtggcagatctggcttggggcgcccgcctgggcgatcggccgtggcttcgtgcagcgctatttcgataactcgttgtcatttgacagcccgcaggccgaaaaaattcgcaaggccgtcaagcgcgccaagctgaccgcggtgatcggcgtctccgaacgcgacggcggcagcctctatatcggccaatggctgatcggtcccgacggcgagaccattgcgaagcgccgcaagctgcggccgacccatgccgaacgcaccgtgttcggcgagggcgacggcagcgacctcgccgtccatgatcgcgccgacgtgggacggctcggtgcaatgtgctgctgggagcatctgcagccgctgtcgaaatacgcgatgtacgcccagaacgagcaggttcacgtcggcgcctggccgagcttctcattgtacgacccattcgcccatgcgcttggctgggaagtaaacaacgcggcgagcaaggtttatgctgtcgagggctcatgtttcttcctcggcccgtgcgcggtggtctcgcaggccatgatcgacgagctctgcgattcccccgaaaagcacgccttcctgcacgctggcggcggccacgcggtaatctatgggccggacgggagttcgcttgccgacaaacttccacccgatcaggagggcattctgtatgccgatatcgatctcggcatgatcggcgtggcaaagaacgccgccgaccccgcaggacactattccaggccggacgtcacgcggctgctgctcaacacttcccgcgccaatcgcgtcgagcatttttcattgccgatcgatgccgaggtcatgagcgaaatcagacttcaggcctga

SEQ ID NO: 86 - protein, 337 aa, Unknown
  Obtained from an environmental sample
MGLVHQKYKVAVVQAAPVFLDLDATVDKTIALIEQAAAQGAKLIAFPETFIPGYPWQIWLGAPAWAIGRGFVQRYFDNSLSFDSPQAEKIRKAVKRAKLTAVIGVSERDGGSLYIGQWLIGPDGETIAKRRKLRPTHAERTVFGEGDGSDLAVHDRADVGRLGAMCCWEHLQPLSKYAMYAQNEQVHVGAWPSFSLYDPFAHALGWEVNNAASKVYAVEGSCFFLGPCAVVSQAMIDELCDSPEKHAFLHAGGGHAVIYGPDGSSLADKLPPDQEGILYADIDLGMIGVAKNAADPAGHYSRPDVTRLLLNTSRANRVEHFSLPIDAEVMSEIRLQA

SEQ ID NO: 87 - DNA, 1062 bp, Unknown
  Obtained from an environmental sample
atggcggaatcgaagctgaaggtcgccgcaattcaagttgcgcccgtgttcatggatcgcgatgccacgatcgcccgcgcctgcgagcggatcgccgaagccgcccgcgccggcgcggagttggtggtctttcccgaggcattcgtgcccgggtatcccgactggatctgggtggcgcggccaagccaacgcaaactgctcaatgatctttacgcgcacctcgtctcgcagtcggtcgacgtgccgtcggcctccgtggatcgtttgcgcgacgcggctcgcgacggcggggtcacggtggtgatcggcgtcaacgagcgcaacaccgaagcgagcggcgcgagcctctacaacaccgcgctcgtgatcggtccactggggcagctgatcggccgccaccgcaagcttgtgccgaccgggccggagcgcatggtgtgggcgcagggcgacggcagcacgctcgacgtctacgacacacccgtcggcaagctttcgacgttgatctgctgggagaactacatgccgctcgcgcgctacgccatggcggcgtggggcgcgcgcatccacgtcgccggcacgtgggaccgcggcgagccgtggatctcgaccatgcgtcatgtggcgacggagggccgcgtattcgtgattagctgttgcatggcgctgcgcaaacgagacattcccgccgagctcgagttcgcgatgctctatcccgacgggcgcgaatggatcaacgccggtgattcgctggtcgtgaatcccgctggccagatcatcgctgggccgttgcacgagcaggaaggaatcctctacgccgagctcgagcgcaatcagatgaccggtccgcgttggatgttcgacgccgccggccattacgcgcgaccggacgtcttccaactcacggtaaaccgctccccgcgcccgatgctgcgggaggcgggggcaaagacgagtgaggcaaacacgagagatgccgtacccatggacagcacgccctcgagatcgcggccccgcgcggtggcgcgaaaggccgcacgcaccggtcgctccaagcggcggtga

SEQ ID NO: 88 - protein, 353 aa, Unknown
  Obtained from an environmental sample
MAESKLKVAAIQVAPVFMDRDATIARACERIAEAARAGAELVVFPEAFVPGYPDWIWVARPSQRKLLNDLYAHLVSQSVDVPSASVDRLRDAARDGGVTVVIGVNERNTEASGASLYNTALVIGPLGQLIGRHRKLVPTGPERMVWAQGDGSTLDVYDTPVGKLSTLICWENYMPLARYAMAAWGARIHVAGTWDRGEPWISTMRHVATEGRVFVISCCMALRKRDIPAELEFAMLYPDGREWINAGDSLVVNPAGQIIAGPLHEQEGILYAELERNQMTGPRWMFDAAGHYARPDVFQLTVNRSPRPMLREAGAKTSEANTRDAVPMDSTPSRSRPRAVARKAARTGRSKRR

SEQ ID NO: 89 - DNA, 918 bp, Unknown
  Obtained from an environmental sample
atgaataccaaagaagtaaaggtcgcagccgctcaatttgccccacattttctgaatttgagcaaaacggtggaaaaaacctgcaacttgatttccgaagcaggcaaaaatggagcaaagctcattgtatttccggaagccttcctctctggttatcccgattgggtctggttaattcccaatggaaattcaacaatgctggatgatttatatcaggaattggttgagaacgctgtaacaatccctgattcaacaacacagaaactctgtcaggcagcaaaagatgccggggtatatgtcgcagtcggtatccatgaaagaaatgcagaagcaagtggcttcacacttttcaatacccttctatacattaatgatcaaggcagcatcattggaaaacaccgaaaactgatcccaacagggggcgaacgcctggtctgggggcagggtaatggggatacgcttgctgcattcgatacacactttggcaaattgggaggattgctttgctgggaaaactacatgcccctggctcggcaagctatgtacgcagttgggactgaagtttatgttgccccaacctgggactccagtgagaattggttgctgagtatgcgccatatagccagagagggcggcatgtttgtgatcaatgtttgccaggctgtccgaaaagacgatattcctgaccgctatgcattcaagcaactctattctggtaattcagaatggatcaatagcggcaacagttgcatcatcaatccgcgcggtgaaatcattgccggaccatcctcaaacaggcaagaaatactctacgcagatttagatctgagtttgattacaaaatctaaacgcatgttcgatgttaccgggcattatgcccggccggatgtgtttagatatgaaatcaaaaaaagctag

SEQ ID NO: 90 - protein, 305 aa, Unknown
  Obtained from an environmental sample
MNTKEVKVAAAQFAPHFLNLSKTVEKTCNLISEAGKNGAKLIVFPEAFLSGYPDWVWLIPNGNSTMLDDLYQELVENAVTIPDSTTQKLCQAAKDAGVYVAVGIHERNAEASGFTLFNTLLYINDQGSIIGKHRKLIPTGGERLVWGQGNGDTLAAFDTHFGKLGGLLCWENYMPLARQAMYAVGTEVYVAPTWDSSENWLLSMRHIAREGGMFVINVCQAVRKDDIPDRYAFKQLYSGNSEWINSGNSCIINPRGEIIAGPSSNRQEILYADLDLSLITKSKRMFDVTGHYARPDVFRYEIKKS

SEQ ID NO: 91 - DNA, 939 bp, Unknown
  Obtained from an environmental sample
atgaccaaaatcgctgtcattcaagaacctccggtctatctgaatctgagtaaatcgatggacagagcggtcgacttgattgccaatgctgcaagcaaggggtgtgagttgattgtgtttcccgaagcctggcttgcaggttaccccaccttcgtctggcgtcttgcgccgggcagcggaatgggaaaaactgatgagctttacgcgcgtttgctcgccaactcggtcgaccgtagcaaagaggggcttagaccattgcaggaggccgcaaaggagcatggcgttgtcattgtgctgggttatcaagaggtggatggcgcgggaagcagcagcacgatcttcaacagctgtgcgattattgatgcggacgggcgactggccaacaatcatcgcaagttgatgcccaccaatccggagaggatggtttggggttttggcgacggttcaggcctgaacgtcgttgacaccgcggtgggcaggatcggcacgctgatttgctgggaaaactacatgccgttagcgcgctacgcgctgtatgtccaaaacatcgaaatctatgttgccccgacttgggacagtggtgccatgtggcaggcgaccctgcagcatatcgcgcgcgaaggtggctgctgggtcatcggatgtgcaacgtcgctggaagcctctgacatcccggacgacgttccccatcgggatgagctattcccgaacaaagacgaatgggtaaaccctggcgatgcggtggtttataagccatttggcggcattgtggccggccccatgcatcaggaaaaggggcttctcatcgcagagttggacgtcgccgctgttcagtcgtcacgtcggaagttcgatgcgagcgggcactacgctcgccccgatgtcttcaaactgcatgtgaatcgcaccgcgatgcggccagttgatttcacgaattag

SEQ ID NO: 92 - protein, 312 aa, Unknown
  Obtained from an environmental sample
MTKIAVIQEPPVYLNLSKSMDRAVDLIANAASKGCELIVFPEAWLAGYPTFVWRLAPGSGMGKTDELYARLLANSVDRSKEGLRPLQEAAKEHGVVIVLGYQEVDGAGSSSTIFNSCAIIDADGRLANNHRKLMPTNPERMVWGFGDGSGLNVVDTAVGRIGTLICWENYMPLARYALYVQNIEIYVAPTWDSGAMWQATLQHIAREGGCWVIGCATSLEASDIPDDVPHRDELFPNKDEWVNPGDAVVYKPFGGIVAGPMHQEKGLLIAELDVAAVQSSRRKFDASGHYARPDVFKLHVNRTAMRPVDFTN

SEQ ID NO: 93 - DNA, 978 bp, Unknown
  Obtained from an environmental sample
atgcccatcatcaaagccgctgccgtgcaaatcagcccggtgctttacagtcgcgaaggcaccgtggacaaggtctgtcaacagatcatcgacctcggtcggcaaggcgtgcagttcgccgtctttccggaaacggtggtgccttactacccgtacttttcgtttgtgcagccggcctttgccatgggcgcacagcacctcaagttgctggatcaatcggtgacagtgccgtcggccgccaccttggccatcggtgaagcttgcaagcaagcagggatagtggtgtccatcggcgtcaacgaacgcgatggcggtacgatctacaacgcgcaattactcttcgatgccgacggcagcctgattcagcatcgccgcaaaatcaccccgacctatcacgaacgcatggtctgggggcaaggcgatggttccggcctgcgcgccatcgacagtgcagtggggcgcattggctccctggcctgttgggagcattacaacccgctggctcgttatgccttgatggccgatggcgagcagatccacgccgcgatgtttcccggctcgctggtgggcgacatttttgccgagcagatcgaagtcaccatccgccatcacgccttggagtccggctgtttcgtggtcaacgccaccgcctggctggacgccgatcagcagggccaaatcatgcaagacaccggttgcagcctcggcccgatctcgggtggctgcttcaccgccatcgtttcccctgaaggcaagttgctcggtgagccgctgcgttccggcgaaggggtggtgatcgccgatctcgatctggcactgatcgataagcgtaaacggatgatggattcggtcgggcattacagtcgcccggaactgctcagcctgttgatcgaccgcacgcccacagcgcatgtgcatgaacgcagcgcgcacctggtggctgtcgctaccgaggagttcgatcatgcaaaccaatga

SEQ ID NO: 94 - protein, 325 aa, Unknown
  Obtained from an environmental sample
MPIIKAAAVQISPVLYSREGTVDKVCQQIIDLGRQGVQFAVFPETVVPYYPYFSFVQPAFAMGAQHLKLLDQSVTVPSAATLAIGEACKQAGIVVSIGVNERDGGTIYNAQLLFDADGSLIQHRRKITPTYHERMVWGQGDGSGLRAIDSAVGRIGSLACWEHYNPLARYALMADGEQIHAAMFPGSLVGDIFAEQIEVTIRHHALESGCFVVNATAWLDADQQGQIMQDTGCSLGPISGGCFTAIVSPEGKLLGEPLRSGEGVVIADLDLALIDKRKRMMDSVGHYSRPELLSLLIDRTPTAHVHERSAHLVAVATEEFDHANQ

SEQ ID NO: 95 - DNA, 966 bp, Unknown
  Obtained from an environmental sample
atgtccaacgagaataacattgctacattcaaagttgccgcagtccaggccacacctgtgtttcttgatcgtgaagcaaccatcgacaaagcttgcgcgttgattgccactgctggcagtgaaggagcgcgcctgattgtgtttccagaagcattcatcccaacttatcctgaatgggtatggggtattccctccggtgagcaaggtttactcaacgaactctatgcagagttgctcaccaatgcggtcaccattcccagcgatgcgactgacaggctgtgcgaggctgcgcagcttgcgaatgcctacgtagtgatgggcatgagcgaacggaacgtcgaggcgagtggcgcaagcctgtataatacgctgttgtacataaatgcgcagggggagattttagggaaacatcgaaagctggtgccaacgggcggcgaacgcctggtatgggcgcagggtgatggcagtacgctgcaggtctacgatactccattgggaaaactcggtggcttaatttgctgggaaaattatatgccgctggcacggtatgctatgtatgcctggggaacacaaatctatgtcgcggcaacgtgggatcgcggtcaaccctggctttctacattaaggcatatcgccaaagaaggcagggtatacgtgattggttgctgtatcgcgatgcgtaaagacgatattccagatcgttacaccatgaagcaaaaatattatgctgaaatggatgaatggatgaatgttggtgacagtgtgattgtcaatcccgaggggcactttattgccgggcctgtgcgcaagcaggaagaaattctctacgcggagattgatcctcgcatggtgcaaggcccgaagtggatgctcgatgtggcagggcattatgcgagaccggatgtgttccagttgacggtgcatacggatgtgaggcggatgatgcgggtggaagatgattcataa

SEQ ID NO: 96 - protein, 321 aa, Unknown
  Obtained from an environmental sample
MSNENNIATFKVAAVQATPVFLDREATIDKACALIATAGSEGARLIVFPEAFIPTYPEWVWGIPSGEQGLLNELYAELLTNAVTIPSDATDRLCEAAQLANAYVVMGMSERNVEASGASLYNTLLYINAQGEILGKHRKLVPTGGERLVWAQGDGSTLQVYDTPLGKLGGLICWENYMPLARYAMYAWGTQIYVAATWDRGQPWLSTLRHIAKEGRVYVIGCCIAMRKDDIPDRYTMKQKYYAEMDEWMNVGDSVIVNPEGHFIAGPVRKQEEILYAEIDPRMVQGPKWMLDVAGHYARPDVFQLTVHTDVRRMMRVEDDS

SEQ ID NO: 97 - DNA, 1017 bp, Unknown
  Obtained from an environmental sample
atgggcatcgaacatccgaaatacaaggtcgccgtggtgcaagctgcgcccgcctggctcgacctcgacgcgtcgatcgacaagacgatcgggctgatcgaggaggcggcgaagaaaggcgccaagctgatcgctttccccgaagccttcattcccggctacccttggcacatctggctcgactcacccgcctgggcgatcggccgcggtttcgtgcagcgctatttcgacaattcgctcgcctacgacagcccacaggcggaaaggctgcgacaggccgtgcggaaggccaagctcaccgccgtgatcggcctgtccgagcgcgacggcggcagcctctatctcgcgcagtggctgatcgggcccgacggtgagaccatcgcaaagcgccgcaagctgcggccgacccatgccgagcgcaccgtctatggcgaaggcgacggcagcgatctcgccgtccatgagcgggccgacatcggccggctcggcgcgctgtgctgctgggagcatctgcagccgctgtcgaaattcgccatgtacgcccagaacgagcaggtacatgtcgcggcctggccgagcttctcgctctacgatcccttcgcgcctgcgctgggcgcggaggtgaacaacgccgcctcccgcatctatgcggtggaaggctcctgcttcgtgctcgcaccgtgcgcgacggtctcgcaggccatgatcgacgagctctgcgatcggccggacaagcacgcgctgctgcatgccggcggcggcttcgccgcgatctacgggcccgacggcagccagatcggcgacaagctgccgcccgagcaggagggcctgctgatcgccgagatcgatctgggcgcgatcggcgtcgccaagaacgcggccgatcccgccgggcattattcgcggcccgacgtcacgcggctcctgctcaacaggaagccgaacaagcgcgtggagcagttcgcgctgcccgtcgacacggtcgagcccgtcgacgtcgcggcggcagcaagctga

SEQ ID NO: 98 - protein, 338 aa, Unknown
  Obtained from an environmental sample
MGIEHPKYKVAVVQAAPAWLDLDASIDKTIGLIEEAAKKGAKLIAFPEAFIPGYPWHIWLDSPAWAIGRGFVQRYFDNSLAYDSPQAERLRQAVRKAKLTAVIGLSERDGGSLYLAQWLIGPDGETIAKRRKLRPTHAERTVYGEGDGSDLAVHERADIGRLGALCCWEHLQPLSKFAMYAQNEQVHVAAWPSFSLYDPFAPALGAEVNNAASRIYAVEGSCFVLAPCATVSQAMIDELCDRPDKHALLHAGGGFAAIYGPDGSQIGDKLPPEQEGLLIAEIDLGAIGVAKNAADPAGHYSRPDVTRLLLNRKPNKRVEQFALPVDTVEPVDVAAAAS

SEQ ID NO: 99 - DNA, 1014 bp, Unknown
  Obtained from an environmental sample
atgcctgacaagagaatcgtccgcgccgccgcggtccagatagcaccggacctcgaacggcccggtggcacgctcgagaaggtcctcgagacgatcgacgacgccgcacgccagggcgtgcagctcatcgtcttccccgagaccttcctgccctactacccgtacttttcgttcgtgcgggcgccggtggcatcgggtgcagagcacatgcggctctatgacgaagcggtggtcgtgcccgggccggtgacgcatgcggtggccgagcgggcacggcggcacggcatggtcgtcgtgctcggcgtgaacgagcgcgatcacggcagcttatacaacgcacaactgatcttcgataccgacggcgagctgctgctcaagcgccgcaagatcacgccgacgtttcacgaacggatgatctggggcatgggcgacgcagccggcctgaaggtagcggaaacgcgtatcggccgggtgggtgcactcgcttgctgggaacactacaacccgcttgcacgttatgcactgatgacccagcacgaagagattcattgcagccagtttcccggctcgctggtcggacccatcttcggtgaacagatcgaagtgaccatccggcatcacgcactggaatccggctgcttcgtgatcaattccaccggctggctgaccgagccgcagatcgagtcgatcacgaaagatccgggcctgcagaaggcgcttcgcggcggctgcaacacggcgatcatctcgcccgaaggccagcatctcgccccgccgctgcgtgagggcgagggcatggtcatcgctgacctggacatgtcgctgatcaccaaacgcaaacgcatgatggattctgtcggccactacgcgcggcccgaactgctgagcctcgccatcaacgaccggccggcggtcacgtcggcacccatgaacagcttctcatcttcaaccgggggattgcaccttgaacgcgaacgagaccttgtcggccgtgagccggcaattgatgactga

SEQ ID NO: 100 - protein, 337 aa, Unknown
  Obtained from an environmental sample
MPDKRIVRAAAVQIAPDLERPGGTLEKVLETIDDAARQGVQLIVFPETFLPYYPYFSFVRAPVASGAEHMRLYDEAVVVPGPVTHAVAERARRHGMVVVLGVNERDHGSLYNAQLIFDTDGELLLKRRKITPTFHERMIWGMGDAAGLKVAETRIGRVGALACWEHYNPLARYALMTQHEEIHCSQFPGSLVGPIFGEQIEVTIRHHALESGCFVINSTGWLTEPQIESITKDPGLQKALRGGCNTAIISPEGQHLAPPLREGEGMVIADLDMSLITKRKRMMDSVGHYARPELLSLAINDRPAVTSAPMNSFSSSTGGLHLERERDLVGREPAIDD

SEQ ID NO: 101 - DNA, 1065 bp, Unknown
  Obtained from an environmental sample
atggcgacagtccatccgaaatttaaagtagccgccgtccaggcggccccggcctttctcgacctcgacgcgtcggtggaaaaagcggtgcgcctgattgatgaagccggcgccgctggtgcccggctcatcgcgtttccagagacttttatccccggttatccgtggtggatctggctcggtgctccggcctgggcgatcatgcgcggcttcgtctcccgctatttcgacaactcgctgcagtacggcaccccggaagccgaccggctgcgggcagccgccaaacgcaacaaaatgttcgtcgcgctcggactgtcagagcgcgacggcggcagtctctacatcgcccaatggattatcggacccgacggcgagacggtcgcaacgcgccgcaagctcaagcctactcacgccgagcggacggtgttcggcgaaggcgatggctcgcaccttgcggtccacgaacttgatatcgggcgggtcggtgcgctgtgctgttgggagcacctgcagccactgtcgaagtacgcgatgtatgcgcagaacgagcaagttcatatcgcggcgtggccgagcttttcgctttacgatccgttcgcgcatgcgcttggcgccgaggtcaacaacgcggcgagcaagatctacgcggtcgaaggctcatgctttgtgattgcgccatgcgcgaccgtttcccaggcgatgatcgacgaattgtgtgactcgcccgagaagcatcagttcctgcacgtcggcggcggtttcgccgtgatctatggtcccgacggcgcgccactcgccaagccactggcgcccgatcaggagggtctcctttacgcggatatcgacctcggcatgatttcggtcgcgaaagcggcggccgatccggctggacattacgcgcgcccggacgtgacccgtctgttgttcaacaatcgtcctgggaaccgggtggagacactcgcgctgccggtcgaccaggaggcagaggcgggagcaggcggcaaacctgcgcccaagtcaccgagtgtcgctgcgttcacactgacgcaggcggcagccgagtag

SEQ ID NO: 102 - protein, 354 aa, Unknown
  Obtained from an environmental sample
MATVHPKFKVAAVQAAPAFLDLDASVEKAVRLIDEAGAAGARLIAFPETFIPGYPWWIWLGAPAWAIMRGFVSRYFDNSLQYGTPEADRLRAAAKRNKMFVALGLSERDGGSLYIAQWIIGPDGETVATRRKLKPTHAERTVFGEGDGSHLAVHELDIGRVGALCCWEHLQPLSKYAMYAQNEQVHIAAWPSFSLYDPFAHALGAEVNNAASKIYAVEGSCFVIAPCATVSQAMIDELCDSPEKHQFLHVGGGFAVIYGPDGAPLAKPLAPDQEGLLYADIDLGMISVAKAAADPAGHYARPDVTRLLFNNRPGNRVETLALPVDQEAEAGAGGKPAPKSPSVAAFTLTQAAAE

SEQ ID NO: 103 - DNA, 945 bp, Unknown
  Obtained from an environmental sample
atgggcgagttcggcgaggtgacgctgggggtggcgcaggcggcgccggtgtacttcgaccgggaggcgtcgacggagaaggctcgcggcctgatccgggaggcgggggagaagggcgtcgacctgttggcgttcggggagacgtggctgacggggtacccgtactggaaggatgcgccgtggtctcgggagtacaacgacctgcgcgcgcggtacgtggcgaatggcgtgatgataccggggccggagacggacgcgctatgccaggcagcggcggaagcgggggtggacgtggcaatcggcgtggtggagctggagccggggagcctttcgagcgtgtattgcacgttgctgttcatctcgcgcgagggcgagatcctggggcggcaccggaagctgaagccgacggattcggaacggcggtactggtcagagggtgatgcgacggggctgcgggtgtacgagcggccatatggccggttgagcggattgaactgctgggaacaccttatgatgttgccggggtacgcgctggcggcacaggggacgcagtttcatgtggcagcgtggccgaacatggcgagctcggcgagcgagctgctgtcgcgggcgtatgcgtaccaggccggatgctacgtgttgtgcgcgggcgggctcgggcctgcgccgggagagctaccggacggcatcgcggcggagtcgctggaccacctgacgggcgagagctgcatcatcgacccgtggggaaaagtgatcgcggggccggtgtcgtgcgaggagacgctgattacggcgcgggtatcgaccgcgtcaatctaccggcgcaagtcgctgacggacgtgggtggccactactcgcgaccggacgtgttccggttcgaggtggataggtcggagcgcccgcgagtggtgtttcgggatggggatgtggacgaccgggggtaa

SEQ ID NO: 104 - protein, 314 aa, Unknown
  Obtained from an environmental sample
MGEFGEVTLGVAQAAPVYFDREASTEKARGLIREAGEKGVDLLAFGETWLTGYPYWKDAPWSREYNDLRARYVANGVMIPGPETDALCQAAAEAGVDVAIGVVELEPGSLSSVYCTLLFISREGEILGRHRKLKPTDSERRYWSEGDATGLRVYERPYGRLSGLNCWEHLMMLPGYALAAQGTQFHVAAWPNMASSASELLSRAYAYQAGCYVLCAGGLGPAPGELPDGIAAESLDHLTGESCIIDPWGKVIAGPVSCEETLITARVSTASIYRRKSLTDVGGHYSRPDVFRFEVDRSERPRVVFRDGDVDDRG

SEQ ID NO: 105 - DNA, 975 bp, Unknown
  Obtained from an environmental sample
atgaccattgtcaaagccgctgccgtccagattgcccccgttctctacagccgtgaaggcactgtagaaaaggtcgttaacaagattcgcgaactcggcgagaagggcgtgcagttcgccgttttccctgaaaccgtcgtaccgtactacccgtacttttcctttgtgcagagccctttcaaaatgggttccgagcactacaaattgctcgaccaggccgttgtcgtgccgtcggcgaccaccgatgccatcggcaaagcggccaaggaagccaacatggtggtgtccatcggcgtcaacgaacgcgatggcagcaccctctacaacacgcagttgctgtttgatgccgacggcactttgattcaggcccgtcgcaagatttcaccgacctaccacgaacgcatgatctggggcatgggcgacggttccggcctgcgcgccaccgacagcgcggtcgggcgcatcggacaattggcctgctgggaacattacaatccgctggcgcgttacgccttgatcgaagacggcgaacagatccacgcctcgatgtacccgggctcgttcgcaggtcctttattcactcgccagatggaagtcagcatccgcatgcatgccctggaatcggcgtgcttcgtggtcaactcgaccgcgtggttgtacccggaacagcaagcccagatcatggccgacaccggttgcgagatcgggccgatctccggcggctgctacaccgcgatcatcgacccacagggtgaagtcgtcggcgcactgaccgaaggcgagggcgaagtgattgccgacatcgatctgttccagatcgaaatccgtaaacgtcagatggacggccgtggtcactacagccgtccggaaatcctgagcctgaacatcgaccgtacgccgcatcgccatgttcacgaacgcaacgaccagcagaaaccgggtgtgatcgacactgctgaagaaaccgggcgttga

SEQ ID NO: 106 - protein, 324 aa, Unknown
  Obtained from an environmental sample
MTIVKAAAVQIAPVLYSREGTVEKVVNKIRELGEKGVQFAVFPETVVPYYPYFSFVQSPFKMGSEHYKLLDQAVVVPSATTDAIGKAAKEANMVVSIGVNERDGSTLYNTQLLFDADGTLIQARRKISPTYHERMIWGMGDGSGLRATDSAVGRIGQLACWEHYNPLARYALIEDGEQIHASMYPGSFAGPLFTRQMEVSIRMHALESACFVVNSTAWLYPEQQAQIMADTGCEIGPISGGCYTAIIDPQGEVVGALTEGEGEVIADIDLFQIEIRKRQMDGRGHYSRPEILSLNIDRTPHRHVHERNDQQKPGVIDTAEETGR

SEQ ID NO: 107 - DNA, 981 bp, Unknown
  Obtained from an environmental sample
atggccatcattcgcgcagcagccgtacagatcagcccggttctttacagccgcgaaggcaccgtggacaaggtctgccagcagatcatcacccttggcaaacagggtgtgcagttcgccgtgttcccggaaacggtggtgccgtactacccctatttttcctttgtgcagccggcgttcgccatgggtgcgcaacacctcaaattgctagatcaatctgtaaccgtgccatcggccgccaccctggcgattggcgaagcgtgcaagcaagcaggaatggtcgtttccatcggagtcaatgaacgcgatggcggtacgatttacaacgcgcaattactcttcgatgctgacggcacgctgattcagcatcggcgcaaaatcaccccgacctaccacgagcgcatggtctgggggcagggcgatggttccggtctgcgcgccatcgacagcgcggtcgggcgcatcggctccctggcatgctgggaacattacaacccgctggcccgttacgccttgatggcagacggcgaacagatccacgccgcgatgtttcccggttccctggtgggtgacatcttcgccgagcagatcgaggtcaccatccgccatcacgcattggagtcaggatgcttcgtggtcaatgcaacagcctggctggatgcggatcagcagggccaaataatgcaggacacaggttgcggccttggtcccatctcgggcggctgcttcaccgcgatcgtatcgccggaagggaagctacttggagagccgcttcgctccggggaaggcgtagtgattgccgacctcgatacggccttgatcgacaagcgcaaacggatgatggattcagtaggtcattacagtcgtcccgagctgctcagcctattgatcgatcgatcgccgactgcgcatgttcatgaacgcgccggctttgtttcgagcaacgccggtttgcaggaggtcgcccatgcagaccaatga

SEQ ID NO: 108 - protein, 326 aa, Unknown
  Obtained from an environmental sample
MAIIRAAAVQISPVLYSREGTVDKVCQQIITLGKQGVQFAVFPETVVPYYPYFSFVQPAFAMGAQHLKLLDQSVTVPSAATLAIGEACKQAGMVVSIGVNERDGGTIYNAQLLFDADGTLIQHRRKITPTYHERMVWGQGDGSGLRAIDSAVGRIGSLACWEHYNPLARYALMADGEQIHAAMFPGSLVGDIFAEQIEVTIRHHALESGCFVVNATAWLDADQQGQIMQDTGCGLGPISGGCFTAIVSPEGKLLGEPLRSGEGVVIADLDTALIDKRKRMMDSVGHYSRPELLSLLIDRSPTAHVHERAGFVSSNAGLQEVAHADQ

SEQ ID NO: 109 - DNA, 1092 bp, Unknown
  Obtained from an environmental sample
atggccatcattcgcgcagcagccgtacagatcagcccggttctttacagccgcgaaggcaccgtggacagggtctgccagcagatcatcacccttggcaaacaaggtgtgcagttcgccgtgttcccggaaacggtggtgccgtactacccctatttttcctttgtgcagccggcatttgcgatgggtgcacaacacctcaaattgctcgatcaatctgtaaccgtgccatcggccgccaccctggcgattggcgaagcgtgcaagcaagcaggaatggtcgtttccatcggcgtcaatgaacgcgatggcggtacgatttacaacgcgcaattactcttcgatgctgacggcactctgattcagcatcggcgcaaaatcaccccgacctaccacgagcgcatggtctgggggcagggcgatggttccggtctgcgcgccatcgacagcgcggtcgggcgcatcggctccctggcatgctgggaacattacaacccgctggcccgttacgccttgatggcagacggcgaacagatccacgccgcgatgtttcccggttccctggtgggtgacatcttcgccgagcagatcgaggtcaccatccgccatcacgcattggaatcaggatgcttcgtggtcaatgcaacagcttggctggatgcggatcagcagggccaaataatgcaggacacaggttgcggccttggtcccatctcgggcggctgcttcaccgcgatcgtatcgccggaagggaagctacttggagagccgcttcgctcaggggaaggcgtagtgattgccgacctcgatatggccttgatcgacaagcgcaaacggatgatggattcagtaggtcattacagtcgtcccgagctgctcagcctattgatcgatcgatcgccgactgcgcattttcatgaacgcgccgggctttgttccgagcgacgccggtttgcaggaggtcgcgcatgcagaccaatgaattgctcgctgacctgcaaatccaaggcctgcgttggccggccgcgcaaatggcttgtcgcgccaaggcggcgccggtccttcagaccacaaggcgctgagcctaggtaa

SEQ ID NO: 110 - protein, 363 aa, Unknown
  Obtained from an environmental sample
MAIIRAAAVQISPVLYSREGTVDRVCQQIITLGKQGVQFAVFPETVVPYYPYFSFVQPAFAMGAQHLKLLDQSVTVPSAATLAIGEACKQAGMVVSIGVNERDGGTIYNAQLLFDADGTLIQHRRKITPTYHERMVWGQGDGSGLRAIDSAVGRIGSLACWEHYNPLARYALMADGEQIHAAMFPGSLVGDIFAEQIEVTIRHHALESGCFVVNATAWLDADQQGQIMQDTGCGLGPISGGCFTAIVSPEGKLLGEPLRSGEGVVIADLDMALIDKRKRMMDSVGHYSRPELLSLLIDRSPTAHFHERAGLCSERRRFAGGRACRPMNCSLTCKSKACVGRPRKWLVAPRRRRSFRPQGAEPR

SEQ ID NO: 111 - DNA, 990 bp, Unknown
  Obtained from an environmental sample
atgcccaaaacagtacgtgccgcagcagtccagatcgcgcccgacctgacgtcacgcgccggcaccgtcgagcgggtcctcaatgcaatcgccgaagctgctgacaaaggcgccgagctgatcgtatttcccgagaccttcgtgccctggtatccctatttcagtttcgttctgccacctgtccagcaaggccctgagcatcttcgtctttatgaggaagcagtcacggtaccatcagcagaaacacgggccgtcgcggacgccgcgcgcaaacgcaatgcggttatcgtccttggcgtcaatgagcgcgaccacggctcgctctataacactcagctgatcttcgacgcggatggcagcctgaaactcaagcgtcgcaagatcacgccgacctatcacgaacggatgatctggggccaaggcgatggcgccggcctgaaggttgtcgacactgccgtcggtcgcgtgggtgccctggcatgctgggagcattacaatcctctggcccgctatactttgatggcccagcatgaggaaattcacgcctctcatttcccgggctcactggtcggcccgatattcggcgagcaaatcgaagtcaccatgcgccaccacgcgttggaatcgggctgtttcgtggtcaatgccaccggctggctgagcgaggagcagatcgcatctattcatccggaccccgccttgcaaaagggcctgcgcgatggctgcatgacctgcatcatcacgccggaaggacgccatgtcgtaccgccgctgacctcgggcgaaggcatcctgatcggcgatctggacatgcggctcattaccaagcgcaagcggatgatggattcggtcggacactatgctcggcctgaactgctgcaccttgtccatgacacgacgcccgcacgcgcacgcgagcaggtcggcctttcaggcgattttcccgatgcggagcaagacaagctatttgaggaggttcataatgcgtga

SEQ ID NO: 112 - protein, 329 aa, Unknown
  Obtained from an environmental sample
MPKTVRAAAVQIAPDLTSRAGTVERVLNAIAEAADKGAELIVFPETFVPWYPYFSFVLPPVQQGPEHLRLYEEAVTVPSAETRAVADAARKRNAVIVLGVNERDHGSLYNTQLIFDADGSLKLKRRKITPTYHERMIWGQGDGAGLKVVDTAVGRVGALACWEHYNPLARYTLMAQHEEIHASHFPGSLVGPIFGEQIEVTMRHHALESGCFVVNATGWLSEEQIASIHPDPALQKGLRDGCMTCIITPEGRHVVPPLTSGEGILIGDLDMRLITKRKRMMDSVGHYARPELLHLVHDTTPARAREQVGLSGDFPDAEQDKLFEEVHNA

SEQ ID NO: 113 - DNA, 993 bp, Unknown
  Obtained from an environmental sample
atgacgaaggaacgcgccgcgcgcagcctgcgcgcagctgccatacagcttgaagccgaagtcggcgacatcgccgccaatctcgcacgcatcgaggcgatggtcgaggaggctgcgggcaagggcgccgaactgatcgccattccggagttctgcacctcccgcatgcccttcgatgcacgcgtgcacgacgccgtgctgccgccggacaacttcgtggtcgatgcctttcgccgcatggcagcgacgcacaactgccggctcggcggctccatgctcattgccgacggtggcgagatctacaaccgctaccacttcgtcgaacccgacggcagcgtgcatctgcacgacaaggatctgccgacgatgtgggagaacgccttctacaccggcggctccgacgacggcgtcttcgacaccggcatcggcggcgtcggcgccgcggtgtgctgggaactggtacgcaccggcaccgtgcgacgcatgctcggtcgcgtcgacgtcgccatgaccggcacgcattggtggacgatgccgcacaactggggcagcgccgtcgcgcgcacgctggccgcgatgacgcagtacaaccgctacatgtccgagaatgcacccaccgaattcgcccgccgcctgggtgtgccggtgctgcaggcctcgcactgcggaagcttccgcaccggtttcttgctgctgccaggcagcgggcgtgcactgccctatgacaccgagtacgtcggcgccacacagatcgtcgatgccgatggccacatcctcgcccaccgtcgcacgcaggaaggccccggtgtcgtcgtcgccgacatcacgctcggtgcccgcacgcccgagctgccactggaagaccgcttctggattcccgagctgccgctcttcctcaaggcctactggcaccaccagaacctgtgcggcaagtcctactaccgtcgcgtcggccgcgatgccggcctggcggcggcggagcgttcggcatga

SEQ ID NO: 114 - protein, 330 aa, Unknown
  Obtained from an environmental sample
MTKERAARSLRAAAIQLEAEVGDIAANLARIEAMVEEAAGKGAELIAIPEFCTSRMPFDARVHDAVLPPDNFVVDAFRRMAATHNCRLGGSMLIADGGEIYNRYHFVEPDGSVHLHDKDLPTMWENAFYTGGSDDGVFDTGIGGVGAAVCWELVRTGTVRRMLGRVDVAMTGTHWWTMPHNWGSAVARTLAAMTQYNRYMSENAPTEFARRLGVPVLQASHCGSFRTGFLLLPGSGRALPYDTEYVGATQIVDADGHILAHRRTQEGPGVVVADITLGARTPELPLEDRFWIPELPLFLKAYWHHQNLCGKSYYRRVGRDAGLAAAERSA

SEQ ID NO: 115 - DNA, 993 bp, Unknown
  Obtained from an environmental sample
atgaaccaaatcattaaagcggcggcagttcaatgtagccctgtgttgtatagccaagcgggtacagtcaagaaaatctgtgacacgattttggagttggggcagcaaggtgtgcaatttgccgtatttcctgaaactgttgtgccttattacccttatttttcttttgtgcaaccaccgtttgccatgggtaaagaacatttaaagctattgcatgaatcggttgtcgtgccatcggcagcaacaactttaattggacaggcatgcaaagaagcgaacatggtggtttctattggtattaatgagcgtgcaggcggcacgatttataacgctcaattgttgtttgatgcggatggttcgattattcagcatcgccgtaaaattaccccaacgtatcatgaacgtatggtgtgggggcaaggcgatggcagtggtttacgtgcgatagattctgctgtaggacgtattgggtcgctggcatgttgggagcattacaaccctttggctcggtttgctttgatggcggatggtgagcaaattcatgcggcgatgtttccgggatcactcgtggggcagatttttgcagatcagatcagtgccaccattcagcaccatgctttagagtcgggctgttttgtggtgaatgccacagcatggcttgacccagagcaacaacaacaaattatgcaagatacaggctgtgaactcggtccaatttcggggggatgttttacggccatcgtttctccagaaggcaaatttttgtctgaaccgatcacacaaggcgaaggttatgtgattgccgatttagacttttccttaatcgaaaaacgtaaacggatgatggattctgttgggcattatagtcgtccagaattactcagtttgttgattgatcgtcgtcctacctcagttttgcatgagttaaaactagagaatccatcgaataacagcatcgaaaaagtgtctgaatttgccgaggtacacgcatag

SEQ ID NO: 116 - protein, 330 aa, Unknown
  Obtained from an environmental sample
MNQIIKAAAVQCSPVLYSQAGTVKKICDTILELGQQGVQFAVFPETVVPYYPYFSFVQPPFAMGKEHLKLLHESVVVPSAATTLIGQACKEANMVVSIGINERAGGTIYNAQLLFDADGSIIQHRRKITPTYHERMVWGQGDGSGLRAIDSAVGRIGSLACWEHYNPLARFALMADGEQIHAAMFPGSLVGQIFADQISATIQHHALESGCFVVNATAWLDPEQQQQIMQDTGCELGPISGGCFTAIVSPEGKFLSEPITQGEGYVIADLDFSLIEKRKRMMDSVGHYSRPELLSLLIDRRPTSVLHELKLENPSNNSIEKVSEFAEVHA

SEQ ID NO: 117 - DNA, 957 bp, Unknown
  Obtained from an environmental sample
atgactcaatccaggataattcgtgctgcggcagcgcagatcgctccggatttgcaggttccaggtaacacgatcgacaaagtttgccgcaccatcagcgaggcggccgcaaaaggcgtacagattattgttttccctgaaaccttggtgccttattacccttacttctcttacatttcaccgcccattcaacagggcaaagaacatttgcggctgtatgaccatgcagtggttgtgcccggctcggaaaccgaggcaatttcagctcttgccgcccaacacaatatggtggtggttttgggtgtgaacgagcgcgatcacggcacactttacaacgcacaaattattttcaacagcgacggaaagattctgttgaagcgccgaaaaattacaccaacttatcacgagcggatggtgtgggggcagggtgacgcttcaggcttgaaggtggttgattccgcagtgggccgtgtgggtgcattggcctgttgggaacactacaaccccttggctcgctattgtttgatggcccagcacgaagaaattcactgtgcgcagtttcccggttcattggtggggcaagtttttgccgaccaaatggaagtgaccattcgtcaccacgcacttgagtcgggctgttttgtcatcaacagcaccgcttggctttctgaagaacaggttcaaagtatttcatccgacagcgcattgcagaaagggcttagaggcggttgtttcacggccattgtcagccctgagggaaagctgttggctgagccgctcaccgagggtgagggcatggtgatcgccgacctcgacatggcgttggttacgaaacgcaaacgcatgatggattcagtgggccattatgcgcgccccgagttgttgagtttgctggttcgggatgaggcttcaagccccatgaaaaaaattcagggagttcaacatgctgagtactga

SEQ ID NO: 118 - protein, 318 aa, Unknown
  Obtained from an environmental sample
MTQSRIIRAAAAQIAPDLQVPGNTIDKVCRTISEAAAKGVQIIVFPETLVPYYPYFSYISPPIQQGKEHLRLYDHAVVVPGSETEAISALAAQHNMVVVLGVNERDHGTLYNAQIIFNSDGKILLKRRKITPTYHERMVWGQGDASGLKVVDSAVGRVGALACWEHYNPLARYCLMAQHEEIHCAQFPGSLVGQVFADQMEVTIRHHALESGCFVINSTAWLSEEQVQSISSDSALQKGLRGGCFTAIVSPEGKLLAEPLTEGEGMVIADLDMALVTKRKRMMDSVGHYARPELLSLLVRDEASSPMKKIQGVQHAEY

SEQ ID NO: 119 - DNA, 984 bp, Unknown
  Obtained from an environmental sample
atggatacactcaaagttggattggttcagatggcccccatctggttgaaccgggataaaaccctgatcaaagttgaggaatacatgcagaaagcaggcaaacagggctgcaacctggtagcttttggtgaagcgctggttcccggctaccccttctgggtggaacgcacagagggcgccagattcaattccaaagtccagaaagaactctttgcacattaccttgatcaggcggtgcagatcgaagccggccaccttgatcctctccaggcattagcccaacaatacaagatggctgtgtacgtggggacgattgaacgcccgcctgagcggagcggccacagcctgtactgctccctaatatttatagacccagaaggcgagatcggctcggttcaccgcaagttgatgcccacccatgaggaacgcctggtctggtcaactggcgatgggcacggcctgcgaacacattctctgggcgcctttaccgttggcggactcaactgctgggaaaactggatgccgctctcccgcacagctctttatgccatgggagaggatcttcatgttgctgcctggcccgggagtcagcgcaatacttatgatataaccaaattcattgccaaggaatctcgctcttatgtgatctccgtatccgggatgatgaaaaaagaaaatatcctctctgaaattccccacagccaattgatgctggaaaatagcgaggatattatggctgatggcggatcctgtctggctggaccagatggagaatggatcatcgagcccatcgtcggagaggaaaccctggtaactgctgaactatcacatcagcgggtcagagaagaaagacagaatttcgacccaacaggtcactacagtcggcctgatgtgacccgcctggtagtcgaccgcaggcgccagcagatcctggagatcaccccggacgaaaaaggaagatcggatgaaaatcaatccctttaa

SEQ ID NO: 120 - protein, 327 aa, Unknown
  Obtained from an environmental sample
MDTLKVGLVQMAPIWLNRDKTLIKVEEYMQKAGKQGCNLVAFGEALVPGYPFWVERTEGARFNSKVQKELFAHYLDQAVQIEAGHLDPLQALAQQYKMAVYVGTIERPPERSGHSLYCSLIFIDPEGEIGSVHRKLMPTHEERLVWSTGDGHGLRTHSLGAFTVGGLNCWENWMPLSRTALYAMGEDLHVAAWPGSQRNTYDITKFIAKESRSYVISVSGMMKKENILSEIPHSQLMLENSEDIMADGGSCLAGPDGEWIIEPIVGEETLVTAELSHQRVREERQNFDPTGHYSRPDVTRLVVDRRRQQILEITPDEKGRSDENQSL

SEQ ID NO: 121 - DNA, 1158 bp, Unknown
  Obtained from an environmental sample
atgagcaaaaaagttctaggcggcagagaaaaagtaaaagttgcagtagttcaggctgcgcccgttttcatggacaaggagaagacgattgaaaaggcttgcaagctaataaaagaagcggggagaaatcgagccgagctcatagcgttctcagagtcattcatccccgtctatcctgcatactataccgtcggctatgaaaccccttctcaagaatggagagattacgtgattgcgctacaggataactccgtgctgattccgagcgaggataccgaggtactcggacaggctgcaaaggaggcaggggcttatgcagtaataggatgcagcgagatggacgaccgtccgggaagccgaacagtttacaacacgctcctcttcatcggcaaagacggcaaggtcatgggaaggcatagaaaactcaaacccacgttcacggagagaatatactggggagagggagatgctggagacataaaggtttttgataccgagatcggcaggatcggaggcctcgtatgctgggagaaccatatgactctagtcagggccgcgatgatacacaggggagaggagtttcatatcgcggtctggccgggaaactggaagggtgcggaaaacaagcttctccaagcagataatagcccaggaggcgccctctgcaaccttcaatctctcattaaagtacacgcctttgaggccggggcgtttgtgctgagcgcttgcggctttttgacgccagaggatttcccggaaaggtggcattatataagggatggtaaccatattaactgcgactgggcactgggcggaagctcaatcgtcaatcccgccggccgttatctcgtcgagcctaactttgagaaggatgcaatcctctatgcggattgttatgcaaaccagataaaagcagtaaaagcggtttttgattcccttggccactattcccgctgggatattgcccaactggcgataaggcaggaagcctggaatccagaggtttctttgatcgattcctcttcgactgaagttgagcttccggcagacgagcttcgaaggatttcggagaagtttgaagtaactgcggataagttggaatctttgcttgaggaaattggaaagattaaaaagcccaggaaacaagccggttcctaa

SEQ ID NO: 122 - protein, 385 aa, Unknown
  Obtained from an environmental sample
MSKKVLGGREKVKVAVVQAAPVFMDKEKTIEKACKLIKEAGRNRAELIAFSESFIPVYPAYYTVGYETPSQEWRDYVIALQDNSVLIPSEDTEVLGQAAKEAGAYAVIGCSEMDDRPGSRTVYNTLLFIGKDGKVMGRHRKLKPTFTERIYWGEGDAGDIKVFDTEIGRIGGLVCWENHMTLVRAAMIHRGEEFHIAVWPGNWKGAENKLLQADNSPGGALCNLQSLIKVHAFEAGAFVLSACGFLTPEDFPERWHYIRDGNHINCDWALGGSSIVNPAGRYLVEPNFEKDAILYADCYANQIKAVKAVFDSLGHYSRWDIAQLAIRQEAWNPEVSLIDSSSTEVELPADELRRISEKFEVTADKLESLLEEIGKIKKPRKQAGS

SEQ ID NO: 123 - DNA, 990 bp, Unknown
  Obtained from an environmental sample
atgtcaactttcaagatcgctaccgtgcagagtgcaccagtatttatggaccgcgaagctaccattgacaagacttgcgagctgatcgccgaagcagcacaagatgacgacgttcgcctagtggtcttccccgaggcctttatccccacctatccggactgggtatggcgtatccctcccggacagcaccagatgcttgccgacctgtacggggagttgctcgagcagtcggtgacgatacccagtctggctaccgagcggctctgtcaggctgcaaagaaagcgggcgtttatgtagctgtgggccttaacgaacgcaatacagaggccagcaacgctaccctgtacaacaccctgctctacattgacgccgagggcaacttgctaggtaagcaccgaaagctggtaccgaccgctcccgaacgcatggtctgggcacagggagatggcagtacccttgaggtctacgagacctccttcggaaaactcagcggactaatctgttgggagaactacatgcctctcgctcgttatgccctgtatgcctggggagtacagctctatttggctcctacttgggatcgaggcgagccctggctttccactctgcggcacattgccaaggaaggacgagtatacgtggtcggctgctctatcgccttacgtaaggaagacatccccgaccgattcgaattcaaggcgaagtactacgcagaggcaggagagtggataaacaaaggtgacagcgtcatcgtcggtcccgatggcgagctcatcgccgggcctctacataaggaacaggggatactctatgctgagctggacacaaggcagatgcacgcccccaagtggaacctggatgtagccggacactacgcgcgcccggacgtgtttcggctgaccgtgagcaaggatggccatccgatgctcggcgttgcccaagggcccaagcatgagccgcaagataagaccgaagtattagagggctag

SEQ ID NO: 124 - protein, 329 aa, Unknown
  Obtained from an environmental sample
MSTFKIATVQSAPVFMDREATIDKTCELIAEAAQDDDVRLVVFPEAFIPTYPDWVWRIPPGQHQMLADLYGELLEQSVTIPSLATERLCQAAKKAGVYVAVGLNERNTEASNATLYNTLLYIDAEGNLLGKHRKLVPTAPERMVWAQGDGSTLEVYETSFGKLSGLICWENYMPLARYALYAWGVQLYLAPTWDRGEPWLSTLRHIAKEGRVYVVGCSIALRKEDIPDRFEFKAKYYAEAGEWINKGDSVIVGPDGELIAGPLHKEQGILYAELDTRQMHAPKWNLDVAGHYARPDVFRLTVSKDGHPMLGVAQGPKHEPQDKTEVLEG

SEQ ID NO: 125 - DNA, 1050 bp, Unknown
  Obtained from an environmental sample
atgacaactgtaaaaaagacggtacgcgcagcagcgatccagatcgcacctgacctcgacagtgcaggcggtacgctggacaaggtttgcacggccattcaaaaggcggcggcacaaggcgcggagctggtggtttttcccgaaaccttcttgccctactatccttacttttcattcgtgcggccgcccttcgcatccggcccggaacacttgctgctatatgaacgcgcagtggcggtgccaggcccggtgaccgatgccgtctctgccgtcgcgcgcagccacggcgtggtggtggtactcggcgtcaatgaacgcgaccatggcacgctgtacaacacccaactggtgttcgacgcgaatggcgaactggtgttgaaacgcagaaaaatcacgccgacttatcacgagcggatgatctggggtcaaggcgacggcagcggactcaaagtagtgcaaacggcggtcggccggctaggcgcgctagcctgttgggaacactacaacccactggcccgttatgcattgatggcgcaacacgaagaaatccattgcgcccagtttcccgggtccatggtcgggcaaatattcgccgaccagatggaagtgacgatacgccatcacgctctcgagtcggcttgcttcgtggtgaatgccacaggctggctgaccgatgcgcaaatcacatcgatcacgccggaccccgcgctacaaaaggcattacgtggcggttgctgcaccgccatcgtctcgccggaaggtgtgctcctggcagagccgctacgcagcggcgaaggcatggtgatcgccgatctcgatatggcactcatcaccaaacgcaaacggatgatggattcggtcggccactatgcgcggcccgaattgttaagcctgcttgtcgacgaccggcgcaaggtaccggtatccgcgctatttgccgacagcaaccctgccaacgggcacacagttttcaccccatccgacataccaacccttgggagcgcacatcatgcaaacagttaccaaaccgaaccagcaactgatcactga

SEQ ID NO: 126 - protein, 349 aa, Unknown
  Obtained from an environmental sample
MTTVKKTVRAAAIQIAPDLDSAGGTLDKVCTAIQKAAAQGAELVVFPETFLPYYPYFSFVRPPFASGPEHLLLYERAVAVPGPVTDAVSAVARSHGVVVVLGVNERDHGTLYNTQLVFDANGELVLKRRKITPTYHERMIWGQGDGSGLKVVQTAVGRLGALACWEHYNPLARYALMAQHEEIHCAQFPGSMVGQIFADQMEVTIRHHALESACFVVNATGWLTDAQITSITPDPALQKALRGGCCTAIVSPEGVLLAEPLRSGEGMVIADLDMALITKRKRMMDSVGHYARPELLSLLVDDRRKVPVSALFADSNPANGHTVFTPSDIPTLGSAHHANSYQTEPATDH

SEQ ID NO: 127 - DNA, 1005 bp, Unknown
  Obtained from an environmental sample
atgatagcacggaagacaataagggcggcggcggtgcagatagcgcctgtgatggaagatcggaaggcgacgaccgacaaggtgtgcgcctacattcaggaagcaggcgagaatggagccgaaattgtggtgtttcctgaaaccttcattcccaattatccctatttctcttttgtaaaacctcccgtgttggcaggtaaggatcaccttaccttgtatgaccaagcggtggaaatccctagccctactaccgaccaagtggggtctatggccaaaaaatggggaatcgtagtggtgttgggcgtgaacgaaagaagccacggcactttgtacaatgcccaaattgtctttgacgctactggtgatattgtattggtgagacgcaaaatcacccctacctatcatgaacggatgatctggggacagggagatggcagtggattaaaagcagtagacacagctgtgggaagagtgggcgctttggcgtgttgggaacactataatccacttgcgcgctacgcccttatggtagaccatgaggaaattcattgcagccaattccctggctctatggtcggccccattttcggtgaccagatagaagtgacgattcgccaccatgcgttggaatcgggttgttttgtcatcaattccacaggttggctgtttgaagagcaaatccaagccatcaccgatgatccgaaactgcacaaagcattgaaagacggctgtatgaccgccattatttctcccgaaggcgtgcatttgaccaaacccttaacagaaggcgaaggcatcatctacgcctatctggacatgaaactcatagacaagcggaaacggatgatggactcggtaggacactatgcacgtccagagttgctctctttgcatatcaacaatgcagagcaaaaaccagccgtttacacctctcctcttaccaaaacggaaaccaaagaagacgtaaaaagctatgatcgcaacaaagaacagcttatcgtctga

SEQ ID NO: 128 - protein, 334 aa, Unknown
  Obtained from an environmental sample
MIARKTIRAAAVQIAPVMEDRKATTDKVCAYIQEAGENGAEIVVFPETFIPNYPYFSFVKPPVLAGKDHLTLYDQAVEIPSPTTDQVGSMAKKWGIVVVLGVNERSHGTLYNAQIVFDATGDIVLVRRKITPTYHERMIWGQGDGSGLKAVDTAVGRVGALACWEHYNPLARYALMVDHEEIHCSQFPGSMVGPIFGDQIEVTIRHHALESGCFVINSTGWLFEEQIQAITDDPKLHKALKDGCMTAIISPEGVHLTKPLTEGEGIIYAYLDMKLIDKRKRMMDSVGHYARPELLSLHINNAEQKPAVYTSPLTKTETKEDVKSYDRNKEQLIV

SEQ ID NO: 129 - DNA, 1011 bp, Unknown
  Obtained from an environmental sample
atgtcagaaaagcgaattattaaagcggctgcagttcaaatcacaccagattttgaatcgcatgatggaaccgtaaagaaggtttgtaatgtaattgatgaagcgggtgctaaaggtgtacagatcattgtattccctgaaacctttattccatattacccatatttttctttcatcactccaccagtgactgctggcgcggagcatttgcggctctatgaaaaaagtgtcgtgatacctggtcccgttactcaagccatttccgaacgtgcacgcatgaataatatggttgttgtacttggtgtaaatgagcgtgataacggcagtctatataacacccagattatttttgatgctaccggtgagatgcttctgaagagaagaaaaatcacacctacctatcatgagcgcatgatttgggggcaaggagatgcttcaggcctgaaggtcgtcgatacggctattgggcgagtcggagcattggcatgctgggagcactataaccctttggctagatacagcctcatgacacagcatgaagaaattcactgtgctcaatttccaggctccatggttggtcagatcttcgcagatcaaatggatgtcacgattcgtcatcatgccttggagtcaggttgcttcgtcatcaactccactggctggttaactgatgatcagatcaaatctatcaccgacgatcccaaaatgcagaaagctttaagaggtggttgcaacacggccattatttctccagaagggaatcatttaaccgagcctttgcgagaaggtgaaggcatggtgattgctgatcttgatatggcactcatcaccaaacgaaaaagaatgatggactcagttggccactacgccagaccagaactgttgagcttagcgatcaatgatgctccggctactccttcattccagatgaacgaacatcgtcttaaatcagtgcaattacctatcgcagaggagcttaaaaatgacaacaagcttagcagtggacagtaa

SEQ ID NO: 130 - protein, 336 aa, Unknown
  Obtained from an environmental sample
MSEKRIIKAAAVQITPDFESHDGTVKKVCNVIDEAGAKGVQIIVFPETFIPYYPYFSFITPPVTAGAEHLRLYEKSVVIPGPVTQAISERARMNNMVVVLGVNERDNGSLYNTQIIFDATGEMLLKRRKITPTYHERMIWGQGDASGLKVVDTAIGRVGALACWEHYNPLARYSLMTQHEEIHCAQFPGSMVGQIFADQMDVTIRHHALESGCFVINSTGWLTDDQIKSITDDPKMQKALRGGCNTAIISPEGNHLTEPLREGEGMVIADLDMALITKRKRMMDSVGHYARPELLSLAINDAPATPSFQMNEHRLKSVQLPIAEELKNDNKLSSGQ

SEQ ID NO: 131 - DNA, 1011 bp, Unknown
  Obtained from an environmental sample
atgtcagaaaagcgaattattaaagcggctgcagttcaaatcacaccagattttgaatcgcatgatggaaccgtaaagaaggtttgtaatgtaattgatgaagcgggtgctaaaggtgtacagatcattgtattccctgaaacctttattccatattacccatatttttctttcatcactccaccagtgactgctggcgcggagcatttgcggctctatgaaaaaagtgtcgtgatacctggtcccgttactcaagacatttccgaacgtgcacgcatgaataatatggttgttgtacttggtgtaaatgagcgtgataacggcagtctatataacacccagattatttttgatgctaccggtgagatgcttctgaagagaagaaaaatcacacctacctatcatgagcgcatgatttgggggcaaggagatgcttcaggcctgaaggtcgtcgatacggctattgggcgagtcggagcattggcatgctgggagcactataaccctttggctagatacagcctcatgacacagcatgaagaaattcactgtgctcaatttccaggctccatggttggtcagatcttcgcagatcaaatggatgtcacgattcgtcatcatgccttggagtcaggttgcttcgtcatcaactccactggctggttaactgatgatcagatcaaatctatcaccgacgatcccaaaatgcagaaagctttaagaggtggttgcaacacggccattatttctccagaagggaatcatttaaccgagcctttgcgagaaggtgaaggcatggtgattgctgatcttgatatggcactcatcaccaaacgaaaaagaatgatggactcagttggccactacgccagaccagaactgttgagcttagcgatcaatgatgctccggctactccttcattccagatgaacgaacatcgtcttaaatcagtgcaattacctatcgcagaggagcttaaaaatgacaacaagcttagcagtggacagtaa

SEQ ID NO: 132 - protein, 336 aa, Unknown
  Obtained from an environmental sample
MSEKRIIKAAAVQITPDFESHDGTVKKVCNVIDEAGAKGVQIIVFPETFIPYYPYFSFITPPVTAGAEHLRLYEKSVVIPGPVTQDISERARMNNMVVVLGVNERDNGSLYNTQIIFDATGEMLLKRRKITPTYHERMIWGQGDASGLKVVDTAIGRVGALACWEHYNPLARYSLMTQHEEIHCAQFPGSMVGQIFADQMDVTIRHHALESGCFVINSTGWLTDDQIKSITDDPKMQKALRGGCNTAIISPEGNHLTEPLREGEGMVIADLDMALITKRKRMMDSVGHYARPELLSLAINDAPATPSFQMNEHRLKSVQLPIAEELKNDNKLSSGQ

SEQ ID NO: 133 - DNA, 1026 bp, Unknown
  Obtained from an environmental sample
atgtcgaccaagcggatcgtacgcgccgctgccgttcagctggcaccggatctggagcggccggagggcacactggagaaggtttgcgcggccatcgacaaggcggcgggggacggtgtgcagctcatcgtcttccccgagaccttcgtaccgtactacccgtacttctctttcgtgcgtgcgccggtcgcgatgggtgccgagcacatgcggttatacgagcgcgcggtagcggtgcccggtccagtaacggccaccgtggcggagcgggcaaaagcgcacgcgatggtcgtcgtgctgggtgtaaacgagcgcgatcacggctcactgtataacgcgcaactgatcttcgacgagaccggccgtctcgtcctcaaacgccgcaagatcactccgacctatcacgagcgcatggtgtgggggcagggcgacggcagcggccttaaggttgtagacaccggtatcggcaggatcggagccctcgcctgctgggagcactacaacccgctcgcgcgctatgcgctcatggcgcagcacgaagagattcattgcgcgcagtttccgggctcgatggtggggccgatcttcgcggatcagatcgaggtcacgatccgccatcacgcgctggagtcgggctgcttcgtcgtcaatgcgaccggctggctgacacccgaacagatcgcgtcgatcacaccggacgcgggtctgcaaaaggcaatcagcgggggctgcaacaccgcgatcatctcgccggagggcgtgcacctggccccgccgttgcgagaaggtgagggcatggtcgtggccgacctcgacatggcgctcatcaccaaacgcaaacgcatgatggattcggtgggtcactacgctcgcccggagttgctcagcctgcgcatcgatagccgcgccgcttcgccgatgtcgtcacaaatggaaatacccgggagcttgcatgaaatcaccagccacgatgtccagccagcaactgatgaccgagctccagtcctccggcttgaggttggctga

SEQ ID NO: 134 - protein, 341 aa, Unknown
  Obtained from an environmental sample
MSTKRIVRAAAVQLAPDLERPEGTLEKVCAAIDKAAGDGVQLIVFPETFVPYYPYFSFVRAPVAMGAEHMRLYERAVAVPGPVTATVAERAKAHAMVVVLGVNERDHGSLYNAQLIFDETGRLVLKRRKITPTYHERMVWGQGDGSGLKVVDTGIGRIGALACWEHYNPLARYALMAQHEEIHCAQFPGSMVGPIFADQIEVTIRHHALESGCFVVNATGWLTPEQIASITPDAGLQKAISGGCNTAIISPEGVHLAPPLREGEGMVVADLDMALITKRKRMMDSVGHYARPELLSLRIDSRAASPMSSQMEIPGSLHEITSHDVQPATDDRAPVLRLEVG

SEQ ID NO: 135 - DNA, 1011 bp, Unknown
  Obtained from an environmental sample
atgtcagacaagcgaatcattaaagcggctgcagttcaaatcactcctgactttgactcagcagatggaaccgttaagaaagtgtgcaaggtaatcgatgaagcaggtgcaaagggagttcaaattattgtattcccggaaaccttcatcccttactacccatacttttcattcattacacctccagtcactgctggcgctgagcatttaaagctttatgagaaaagtgtcgtgatacctggcccggttacccaagcgattgccgagcgagccagggttaatcagatggttgtcgtgcttggtgtcaacgagcgagataacggtagcctctacaacacacaattgatctttgataccaacggcgaactgctacttaaaagaagaaaaatcacccctacctaccatgaacgtatgatctgggggcaaggtgatgcatcaggtctcaaagtagttgaaacagagatcgcccgagtaggtgccttggcttgttgggaacactacaacccactggccagatatgcactcatgacacagcatgaagaaattcactgtgcgcaattcccaggctctatggttggccagatatttgccgatcagatggatgtcactatccgacatcacgccttagagtcaggctgcttcgtcatcaacgccactggctggctcaccgacgcgcaaatccaatcgattactgatgacccaaaaatgcaaaaagcattacgtggcggctgcaacacagccatcatctcccccgaaggggtgcacttaacagagccactacgtgaaggagaaggcatggtgattgccaatcttgatatggcactcatcacaaaacgaaaaagaatgatggattcggtaggccattattcaagaccagaattattaagcctggcaattaacgacaaaccagcaactacaacattttcaatgactgaggggcgtactcaaacagagccatttcgaatcgcagaggagttgaaaaatgacgacaagcttagcactggaaactaa

SEQ ID NO: 136 - protein, 336 aa, Unknown
  Obtained from an environmental sample
MSDKRIIKAAAVQITPDFDSADGTVKKVCKVIDEAGAKGVQIIVFPETFIPYYPYFSFITPPVTAGAEHLKLYEKSVVIPGPVTQAIAERARVNQMVVVLGVNERDNGSLYNTQLIFDTNGELLLKRRKITPTYHERMIWGQGDASGLKVVETEIARVGALACWEHYNPLARYALMTQHEEIHCAQFPGSMVGQIFADQMDVTIRHHALESGCFVINATGWLTDAQIQSITDDPKMQKALRGGCNTAIISPEGVHLTEPLREGEGMVIANLDMALITKRKRMMDSVGHYSRPELLSLAINDKPATTTFSMTEGRTQTEPFRIAEELKNDDKLSTGN

SEQ ID NO: 137 - DNA, 978 bp, Unknown
  Obtained from an environmental sample
atggctattgtcaaggccgcggcggtgcagatcagtccggtgctctacagtcgcgccggcacagtggacaaggtcgtcgcgaagatccgcgagctgggccgacgaggggtcgagttcgccgtcttccccgagaccgtcattccctactatccctacttctctttcgtgcagcccccctacacccaggccaccgaacacctgcgcctgctcgaggaatcggtgaccgtgccctccgccgaaaccgacgcgatcgccaaggccgctcgcgaggcgggcatggtcgtctccatcggcgtcaacgagcgcgacggcggaaccatctacaacacccaactcctcttcgacgccgacggcactctcatccagcgccgccgcaagatcacccccacctatcacgaacgcatggtctgggggcagggagacggctcaggtctgcgcgccgtcgacagtgcggtcggccgcatcggccagctcgcctgctgggagcactaccagccactggcccggtacgccctcatcgctgacggcgagcagatccacgccgcgatgtaccccggcgccttcggcggcgatctgttcgccgagcagatcgaggtcaacatccgccagcacgccctggaatccgccagcttcgtcgtcaacgccaccgcctggctcgacgccgatcagcaggcccagatcgccaaggacaccggaggcccggtcccggccttctccggtggcttcttcaccgccatcgtcgaccccgaaggccgtatcatcggcgaccccctcaccagcggcgaaggcgaagtgatcgccgacctcgatctcgctctcatcaaccgccgcaagcgcctcatggacgccagtggacactaccagccgcccgaaattcttagcttcacattgaccggtgcaccggcgccttatgtcaagagcgcggcgtgccggggaaccccgggtacgaccgtggccgaggagggacggtccgcttag

SEQ ID NO: 138 - protein, 325 aa, Unknown
  Obtained from an environmental sample
MAIVKAAAVQISPVLYSRAGTVDKVVAKIRELGRRGVEFAVFPETVIPYYPYFSFVQPPYTQATEHLRLLEESVTVPSAETDAIAKAAREAGMVVSIGVNERDGGTIYNTQLLFDADGTLIQRRRKITPTYHERMVWGQGDGSGLRAVDSAVGRIGQLACWEHYQPLARYALIADGEQIHAAMYPGAFGGDLFAEQIEVNIRQHALESASFVVNATAWLDADQQAQIAKDTGGPVPAFSGGFFTAIVDPEGRIIGDPLTSGEGEVIADLDLALINRRKRLMDASGHYQPPEILSFTLTGAPAPYVKSAACRGTPGTTVAEEGRSA

SEQ ID NO: 139 - DNA, 999 bp, Unknown
  Obtained from an environmental sample
atgaaaacaacggttaccgttgcctgcgttcaggccgcccccgtatttatggatttagaaggcaccgtagataaaacaatcaccctcatctctgaagccgcacagaaaggcgcggagctcatcgcttttccggagacctggatacccggttacccgtggttcttatggctgaactcgcccgccacaaatatgcccctggtttatcagtatcatcagaactctctggtgctggacagtacccaggcgaagcgaattgcggatgcggcacggcagaataacatcactgtcgctctgggcttcagcgaacgcgatcatggaagcctctatatcgcacagtggctgattggcagcgacggggagaccattggcatccggcgcaagctcaaggccacgcacgtggagcgtacgctgttcggcgaaagcgacggctcctccctgaccacctgggagacacctctgggtaacgtcggggccctctgctgctgggagcacctgcagccgctgtcccgctatgcaatgtattcccagcatgaggagatccacatcgctgcctggcccagtttcagtctctacaccagtgcaacggccgcactgggtcctgacgtcaatacggcggcttcacgcctctatgccgcggaggggcagtgcttcgtgatagccccgtgtgccgtggtttctgatgaaatgattgatttactctgtcctgatgatgaccggagagcgttactcagtgccggagggggacatgcccgtatttacggcccggacggaagagaactcgtcacccctctcggggaaaatgaggaaggactgcttatcgctgagctcgactctgctgcgattacctttgccaaactggcggcagacccggttggccactattcccgtcctgacgtgacccgcctcctttttaatccttcagccaacaagactgtgattaaacgacattcgcctcctgagttaattgccgagcagactgcagaagaagaggaggagtag

SEQ ID NO: 140 - protein, 332 aa, Unknown
  Obtained from an environmental sample
MKTTVTVACVQAAPVFMDLEGTVDKTITLISEAAQKGAELIAFPETWIPGYPWFLWLNSPATNMPLVYQYHQNSLVLDSTQAKRIADAARQNNITVALGFSERDHGSLYIAQWLIGSDGETIGIRRKLKATHVERTLFGESDGSSLTTWETPLGNVGALCCWEHLQPLSRYAMYSQHEEIHIAAWPSFSLYTSATAALGPDVNTAASRLYAAEGQCFVIAPCAVVSDEMIDLLCPDDDRRALLSAGGGHARIYGPDGRELVTPLGENEEGLLIAELDSAAITFAKLAADPVGHYSRPDVTRLLFNPSANKTVIKRHSPPELIAEQTAEEEEE

SEQ ID NO: 141 - DNA, 1026 bp, Unknown
  Obtained from an environmental sample
atggtgttcaaggcagcgactgttcatgcagctccggtattcatggacaaggaagcgtcgatagataaggctatcgacctcatcaagaaggccggtcaggaagggattaagcttctggtttttccggaaacgtttattccgggctatccgtattttatcgaatgctatccgccgcttgcgcaggtggaagcgctcgcccagtacactgacgcttccgtggagatcgacggcccggaagtcacccggcttcagcaggtagccaaggcggcaggcgttgcagtcgtcatgggcatcagcgaacgaatggctgagacccgaacctgcttcaactcgcaggtgttcattgacgtcgacggcacgctgctcggcgtgcatcgcaagctgcagccgacttatgccgagcgcaaggtatgggcacagggcggtggttatacgctgaggacctacaagagctcgcttggcgtgctcggcggtcttgcctgctgggagcacacgatgaacctcgcgcggcaggccctgatcatgcagagcgagcagatccatgcggctgcatggcccggactatcgacgatgcgaggtttcgagcccgtggccgatatccagatcgacgccatgatgaagactcacgcgcttaccgcacagtgctgggtgctttcggccggcaatcccgtcgaccggacctgcctcgactggatggaaaagaacatcggaccgcaggattacgtcaccgagggcggcggatggagcgccgttatccatccgttcaacagctatctcggcggccctcacacgggccttgaggaaaagctggtcgtcggcgagatcaatctggacgatctcaagttcgtcaaagtctggctcgacagcaaagggcactatgctcggccggaaatcctgaaacttggcgtcaaccaaaagcagatttggcctgatgaacatttgctggcgcggcaggatgtgaccgagttgctggaggcggatatcatcgaataccccttgcaactgttgcaagaccgcgcgcaatag

SEQ ID NO: 142 - protein, 341 aa, Unknown
  Obtained from an environmental sample
MVFKAATVHAAPVFMDKEASIDKAIDLIKKAGQEGIKLLVFPETFIPGYPYFIECYPPLAQVEALAQYTDASVEIDGPEVTRLQQVAKAAGVAVVMGISERMAETRTCFNSQVFIDVDGTLLGVHRKLQPTYAERKVWAQGGGYTLRTYKSSLGVLGGLACWEHTMNLARQALIMQSEQIHAAAWPGLSTMRGFEPVADIQIDAMMKTHALTAQCWVLSAGNPVDRTCLDWMEKNIGPQDYVTEGGGWSAVIHPFNSYLGGPHTGLEEKLVVGEINLDDLKFVKVWLDSKGHYARPEILKLGVNQKQIWPDEHLLARQDVTELLEADIIEYPLQLLQDRAQ

SEQ ID NO: 143 - DNA, 1122 bp, Unknown
  Obtained from an environmental sample
atgacgatcattgcaggcgcggttcatgcggcgccggtattcatggatgtcgatgccactatcgacaaggcatgcgaaatcattcgcaaggcaggcaaagacggaatcgagcttctcgtcttccctgaggttttcgtacccggctacccctacttcatcgagtgctatccgaccttgaaccaaaccgctgcgctggccgcctatacggatgcctcgatcgaggttccaggcccggaagtccggcgcttgcaggtggccgcacatcaggccggcgtgatggttgtgatgggcgtgagcgagcgtctgcgcggatctcgcacctgcttcaacagccaggtgttcatcgaccgtgacggcaccttgctgggcgtgcaccgcaaactccagccgacctatgtcgagcgcatcgtctggggccagggcggcggacacaccctcaaggtattcgacagcacactgggcaaggtgggcggactggcctgctgggagcacacgatgaacctcgcgcgccatgcgttgatcgcccagggtatccagatccatgccgccgcctggcctgggctttcgacaatggccgggttcgaagcggtggctgacgtccagatcgacgcgatgatgaaaactcatgcgttgagcgcgcaatgctttgtcgtatcggccgcaaaccctgtggatcagacctgcctggagtggatggagaaacacctcggcccgcagcaactcgttaccgccggcggaggctggtcggcaatcgtccatcctttctgtggttatatcgccgcccctcacaccggtgccgaggagaaggttctggtaggcgaaatcaatctggacgacctcaagcaggtcaaggtatgggttgattccgcaggtcattatgcgcgcccggaagtcgtgcaattgcgcgacgccctggagagccgtggcaattatcgcgttgcgctgacccgcgacgccgacaccttcgtgccgctggaagaccgcgtgcgctttgcgcgccagcagaacgccgacctcttcatctcgatccacgccgacgccaacgccaaccacgatgcgcgcggggctggcttcacttcgaaggttgaaaacctttccacgggcattttaccaggcgattga

SEQ ID NO: 144 - protein, 373 aa, Unknown
  Obtained from an environmental sample
MTIIAGAVHAAPVFMDVDATIDKACEIIRKAGKDGIELLVFPEVFVPGYPYFIECYPTLNQTAALAAYTDASIEVPGPEVRRLQVAAHQAGVMVVMGVSERLRGSRTCFNSQVFIDRDGTLLGVHRKLQPTYVERIVWGQGGGHTLKVFDSTLGKVGGLACWEHTMNLARHALIAQGIQIHAAAWPGLSTMAGFEAVADVQIDAMMKTHALSAQCFVVSAANPVDQTCLEWMEKHLGPQQLVTAGGGWSAIVHPFCGYIAAPHTGAEEKVLVGEINLDDLKQVKVWVDSAGHYARPEVVQLRDALESRGNYRVALTRDADTFVPLEDRVRFARQQNADLFISIHADANANHDARGAGFTSKVENLSTGILPGD

SEQ ID NO: 145 - DNA, 1014 bp, Unknown
  Obtained from an environmental sample
atgggcatcacccacccgaactacaaggtcgcagtggtccaggctgcgccggtctggttgaacctcgaggcaacggtcgagaagacaatcaggtatattgaagaggcggccaaggctggagcgaagctgatagcgtttccggaaacctggattccgggctatccatggcacatttggatcggaacgcccgcatgggcaatcggtaagggcttcgtccagcgctatttcgacaactcgctcagctatgacagcccgctcgcgcggcagatcgctgacgccgcagcaaagagcaagatcacggttgttctcggcctctccgagcgcgacggtggaagcctatacatcgcgcaatggctgatcggaccagatggcgagaccatcgcgaagcggcgcaagctgcgtccgacccacgtcgagcgcacggtgttcggtgacggtgacggcagccacatcgccgtgcatgaccgatccgatctgggccggctcggggcgttgtgctgctgggagcacgtgcagccgttgacgaaattcgcgatgtacgcgcagaacgagcaggttcacgtggcagcatggccgagcttctcgatgtacgaaccctttgcgcatgcgctgggttgggagacgaacaacgcggtcagcaaggtctacgcggtcgagggatcgtgcttcgtgctcgctccctgtgccgttatttcgcaagcgatggtggacgagatgtgcgacactcccgacaagcgcgagcttgttcacgccggcggcggccacgcggtgatttacggccctgacggaagcccgctcgcagaaaagctcggggaaaacgaagaggggcttctctacgcgacggtcaatcttgctgcgatcggggttgccaagaatgccgcggatccggccgggcactattcgcgtccggacgttctaaggctgctattcaacaagagcccggcccgaagagtggagcattttgcgctgccgcacgagcagctcgagatcggggcaggcccgtctggcgactga

SEQ ID NO: 146 - protein, 337 aa, Unknown
  Obtained from an environmental sample
MGITHPNYKVAVVQAAPVWLNLEATVEKTIRYIEEAAKAGAKLIAFPETWIPGYPWHIWIGTPAWAIGKGFVQRYFDNSLSYDSPLARQIADAAAKSKITVVLGLSERDGGSLYIAQWLIGPDGETIAKRRKLRPTHVERTVFGDGDGSHIAVHDRSDLGRLGALCCWEHVQPLTKFAMYAQNEQVHVAAWPSFSMYEPFAHALGWETNNAVSKVYAVEGSCFVLAPCAVISQAMVDEMCDTPDKRELVHAGGGHAVIYGPDGSPLAEKLGENEEGLLYATVNLAAIGVAKNAADPAGHYSRPDVLRLLFNKSPARRVEHFALPHEQLEIGAGPSGD

SEQ ID NO: 147 - DNA, 1098 bp, Unknown
  Obtained from an environmental sample
atgacccagcacgagaccactgcccggaggctggcagctgtgcatgccgcgcctgtgttcatggacaccgacgcgaccatcgacaaggtgatcggcttcgtcgaacaggccggccgcgaaggcatcgaactcctggtgttccccgagaccttcgtgcctggttacccctactggatcgagtgctatccgccgctgcagcaggtggccgccaacgcgcagtacacggacgcctccgtcgaggtgcctggtccggagatcaagcgggtgcaggcggcctgtgcccgcgctggcgtcgaagtcgtcctcggcgtcagcgagcgactcaggggtaccaggacatgcttcaactcccaggtgttcatcgacgccgacgggagcctgctcggcgtgcaccgcaagctgcagccgacgtacgtggagcgcatcgtgtgggcccagggcggaggcgcgaccctgtcggtgttcggctcccgctccggccggatcggcggtctggcctgctgggagcacacgatgaacctggctcgtcaggcactgcttgagcaggagcagcagatccacgcggcggcgtggcctgccctgtcgacgatggcggggttcgagaccgtcgcggacgcccagatcgaggccatgatgaagacccatgcgctcacggcacaggtgttcgtcatctgcgcgtccaacccggtcgacggcacttgcctggaatggatgcgggacaacctcggtgaacagaagttcgtgaccgccggagggggctggtccgcggtcatccaccccttcaactccttcctcggcgggccgcataccggtttggaggagaagctcgtcagcgcgacgatcgacttctccgacatccgcttggtcaaggcctgggttgattcgaaggggcactacgcgcggcccgaggtcctgcgactcgcggtcgaccgcaagccactgtggcacgacgagtgcgaggtgccgggacaggcgcaggtacgcacccgcgctgcttctctggcagtgcaggagcacccggtggtgctgcctcagggggcggcgcggcccgctccgcaagactgggacacctctgcggcgcaggagctgacttcctga

SEQ ID NO: 148 - protein, 365 aa, Unknown
  Obtained from an environmental sample
MTQHETTARRLAAVHAAPVFMDTDATIDKVIGFVEQAGREGIELLVFPETFVPGYPYWIECYPPLQQVAANAQYTDASVEVPGPEIKRVQAACARAGVEVVLGVSERLRGTRTCFNSQVFIDADGSLLGVHRKLQPTYVERIVWAQGGGATLSVFGSRSGRIGGLACWEHTMNLARQALLEQEQQIHAAAWPALSTMAGFETVADAQIEAMMKTHALTAQVFVICASNPVDGTCLEWMRDNLGEQKFVTAGGGWSAVIHPFNSFLGGPHTGLEEKLVSATIDFSDIRLVKAWVDSKGHYARPEVLRLAVDRKPLWHDECEVPGQAQVRTRAASLAVQEHPVVLPQGAARPAPQDWDTSAAQELTS

SEQ ID NO: 149 - DNA, 942 bp, Unknown
  Obtained from an environmental sample
atgacgaagcttgagaaggtggtcgcggcggcggtccaggcgacgccggagttcctcgaccgcgaggcgaccgtcgagaaggccgtgcggctgatcaaggaagcggccggggagggcgccggcctgatcgtgttccccgagacgttcatcccgacgtacccggactgggtctggcgcgcgccggcctgggacggcccatccgcggacctgtacgcaatgctgctggagaacgcggtggagatccccgggccggtgacggagaccctggggaaggcggcgaagcaggccaaggccttcgtgtcgatgggcgtcaacgagcgcgagccgggcggcgggacgatctacaacacgcaggtcacgttcggacccgacgggagcgtgctcggcaagcaccgcaagctgatgccgaccggcggcgagcgcctggtgtgggggatgggcgacgggtcgatgctccaggtctatgacacgccgttcggccgcctgggcgggctgatctgctgggagaactacatgccgctcgcgcgctactcgatgtacgccaagggcgtggacgtctacgttgcgccgacgtgggacaacagcgacatgtgggtggcgacgctccgccacatcgccaaggaggggcggctgtacgtgatcggcgtggcgccgctgctgcgcgggtcggacgtccccgacgacgtgccggggaaggccgagctgtggggcggcgatgacgactggatgtcgcgcggcttctccaccatcgtcgcgccgggcggcgaggtgctggccggtccgctgacggaggaggaaggcatcctctacgcggagatcgacccggcgagagcccgttcgtcacggcaccagttcgatccggtggggcactactcgcgccccgacgtgtttcggctcgtcgtggacgagtcgcccaagccccagacgtccggcccgggctag

SEQ ID NO: 150 - protein, 313 aa, Unknown
  Obtained from an environmental sample
MTKLEKVVAAAVQATPEFLDREATVEKAVRLIKEAAGEGAGLIVFPETFIPTYPDWVWRAPAWDGPSADLYAMLLENAVEIPGPVTETLGKAAKQAKAFVSMGVNEREPGGGTIYNTQVTFGPDGSVLGKHRKLMPTGGERLVWGMGDGSMLQVYDTPFGRLGGLICWENYMPLARYSMYAKGVDVYVAPTWDNSDMWVATLRHIAKEGRLYVIGVAPLLRGSDVPDDVPGKAELWGGDDDWMSRGFSTIVAPGGEVLAGPLTEEEGILYAEIDPARARSSRHQFDPVGHYSRPDVFRLVVDESPKPQTSGPG

SEQ ID NO: 151 - DNA, 993 bp, Unknown
  Obtained from an environmental sample
atgagagtcgttaaagccgccgcggtccaactgaaaccagtcctttatagccgtgagggaacagtcgataacgtcgtcaagaagatccacgagctgggccaacaaggagtgcagttcgcaacgttcccggaaaccgtggtgccttactatccgtacttttcgatcgtgcagtccggctatcaaatccttgccggcggtgagttcctaaagctgcttgatcagtcagtgaccgtgccatctcttgccaccgaagcgatcggcgaggcctgcaggcaagcgggcgtcgttgtctccatcggcgtcaacgagcgtgacgggggaactctgtacaatacgcaacttctctttgatgccgacggcacgttgattcaaagacgacgcaagatcacgcccacccattacgagcgcatggtctggggccagggcgatggctcaggtttacgggcggttgacagcaaggtcgcgcgcattggtcaactggcttgttttgagcactacaacccgcttgcgcgttacgccatgatggccgatggcgagcaaatccactctgcgatgttcccgggctccatgttcggcgatgcgttttcagagaaggtggaaatcaacgtaaggcagcatgcaatggagtctggatgctttgtcgtctgcgctacggcctggctggatgccgaccaacaggcacaaatcatgaaggacacaggctgcgagatcggtccgatctcgggcggttgcttcaccgctatcgtgacacccgacgggacgctgataggcgaacccatccactcgggcgaaggcgtttgtattgccgacctcgatttcaagctcatcgacaagcggaagcacgtggtggacacgcgcggccactacagccggccagaattgctcagcctcctaattgatcggactcccacggcacacatacacgaacggaacgagcaaccgaagtcggccgttgagcaagactcgcagaatgtattcaccgctattgcttaa

SEQ ID NO: 152 - protein, 330 aa, Unknown
  Obtained from an environmental sample
MRVVKAAAVQLKPVLYSREGTVDNVVKKIHELGQQGVQFATFPETVVPYYPYFSIVQSGYQILAGGEFLKLLDQSVTVPSLATEAIGEACRQAGVVVSIGVNERDGGTLYNTQLLFDADGTLIQRRRKITPTHYERMVWGQGDGSGLRAVDSKVARIGQLACFEHYNPLARYAMMADGEQIHSAMFPGSMFGDAFSEKVEINVRQHAMESGCFVVCATAWLDADQQAQIMKDTGCEIGPISGGCFTAIVTPDGTLIGEPIHSGEGVCIADLDFKLIDKRKHVVDTRGHYSRPELLSLLIDRTPTAHIHERNEQPKSAVEQDSQNVFTAIA

SEQ ID NO: 153 - DNA, 1074 bp, Unknown
  Obtained from an environmental sample
atgccaaacgcaagaaagattgttggagccgtggcccaagttgcacaggaattcttcgacactgaagcgaatctcggtaaagcgatagcggcgattcacaatgctgcgaagcaaggcgcagatatcgtcgtcttcgccgaatgctatttgggccaatatccatattgggcgcaattttacgacaactctgccaagaactattccaaggtttggacggccctgtacgacggtgcgatcactgtgggtggcgatgaatgccgggctattgctgctgcggctagacagtccaagattcatgtcgtcatgggttgcaatgagctatccgaccgagccggcggcgcaacgttatacaacagcctcttgtttttcgaccgaaagggcgagttgatcggtcgacaccggaaattgatgccgtcgatgcacgagcggttgatccatggcacaggcgacggaagagacttgaatgtttacgataccgatatcggtatgttgggtgggttgatttgctgggagcaccatatgtcgctctcgaagtatgccatggcgactatgggtgaagaagttcatgttgcaagctggcctgggatgtggcgcggaggagacgcggcaatcggtgagaggatggtcgaagcggatcttggggcgccgtttgtttgtgacgccgaatttgcgatccgagaatatgcggcagagacaggaaatttcgttctaagcgcgtctggatattttccgaaggacaatatatccgatgagtggcgcgaagcgattccaaaccttcaagcgcagtgggctgtgggcgggagttctatcgtggcaccggggggctcctatctggtcccaccactcattaatgaggagaagatcctctgcgccgaactcgatttcaatctcaggcgtctttggaaagcctggatcgatccgattggtcactattcgcgtcccgatgtttatagcctgcaactgcataacgttgctgggcgtgagtattcctatcaggccgtagatttgaagcgcacgccaaagccccaatcgctgtgggtagatgcgtccgaggaagacggtgcgctgaattga

SEQ ID NO: 154 - protein, 357 aa, Unknown
  Obtained from an environmental sample
MPNARKIVGAVAQVAQEFFDTEANLGKAIAAIHNAAKQGADIVVFAECYLGQYPYWAQFYDNSAKNYSKVWTALYDGAITVGGDECRAIAAAARQSKIHVVMGCNELSDRAGGATLYNSLLFFDRKGELIGRHRKLMPSMHERLIHGTGDGRDLNVYDTDIGMLGGLICWEHHMSLSKYAMATMGEEVHVASWPGMWRGGDAAIGERMVEADLGAPFVCDAEFAIREYAAETGNFVLSASGYFPKDNISDEWREAIPNLQAQWAVGGSSIVAPGGSYLVPPLINEEKILCAELDFNLRRLWKAWIDPIGHYSRPDVYSLQLHNVAGREYSYQAVDLKRTPKPQSLWVDASEEDGALN

SEQ ID NO: 155 - DNA, 1041 bp, Unknown
  Obtained from an environmental sample
atgggcatcgaacatccgaaatacaaggtggccgtggtgcaggccgcgccggcctggctcgatctcgacggctcgatcaagaaggcgattgcgctgatcgaggaagcggccgccaagggcgctaagctgatcgctttccccgaaaccttcattcccggctatccctggcacatctggctggactcgccggcctgggcgatcggccgcggctttgtgcagcgctacttcgataactcgctggcctacgacagcccgcaagccgaaaagctgcgcgccgcggtcaagaaggccaagctcactgccgtgattggcctgtcggagcgcgacggcggcagcctctatatagcgcaatggctgattggccctgatggcgagaccatcgcaaaacgcagaaagctgcggccaacgcacgcggaacgcaccgtttttggcgagggtgacggcagcgaccttgccgtgcacgaccggcccggaatcgggcggctgggagcgctgtgctgctgggagcacctgcaaccgctttcgaaatacgcgatgtatgcgcagaacgaacaggtccatgtcgcgtcatggccgagcttctcgctctacgaccccttcgcgccggcgctcggcgccgaggtcaacaatgcggcttcccgcgtctacgcggtcgagggctcgtgcttcgtgctggcgccgtgcgccacggtttcgcaagccatgatcgacgagctgtgtgaccggccggacaagcatgcgctgttgcacgccggtggcggacacgccgcgatttacggcccggacggcagctcgatcgcggagaagctgccgcaggacgcggagggcctgttgatcgccgagatcgatctcggggcgatcggggttgccaagaatgcagccgacccggccggtcattattcgcggccggacgtgacgcgactcctgctgaacaagaaccggatgcgaagggtcgaggagtttgcgctgccggtcgatccggtcgcaacgaccgaggaggagcaagtcgcgacgccgtcgaggcccagccaggccgcgtaa

SEQ ID NO: 156 - protein, 346 aa, Unknown
  Obtained from an environmental sample
MGIEHPKYKVAVVQAAPAWLDLDGSIKKAIALIEEAAAKGAKLIAFPETFIPGYPWHIWLDSPAWAIGRGFVQRYFDNSLAYDSPQAEKLRAAVKKAKLTAVIGLSERDGGSLYIAQWLIGPDGETIAKRRKLRPTHAERTVFGEGDGSDLAVHDRPGIGRLGALCCWEHLQPLSKYAMYAQNEQVHVASWPSFSLYDPFAPALGAEVNNAASRVYAVEGSCFVLAPCATVSQAMIDELCDRPDKHALLHAGGGHAAIYGPDGSSIAEKLPQDAEGLLIAEIDLGAIGVAKNAADPAGHYSRPDVTRLLLNKNRMRRVEEFALPVDPVATTEEEQVATPSRPSQAA

SEQ ID NO: 157 - DNA, 1011 bp, Unknown
  Obtained from an environmental sample
atgagagtcgttaaagctgctgcggtccaactgagtcccgtgctgtatagccgtgagggaacagtagaaaaggtcgttcggaagatccacgagcttggcgatcaaggagtcgagttcgccacgttcccggagaccgtagtgccctactatccgtacttctcggccgtccagacgccgattcagaacatgcacggcccggagcacctgaagttgctcgagcaatcggtgaccgtcccgtcgcccgccaccgacgcgatcggcgacgcctgccgccacgccggcgtcgtcgtctcgatcggcgtcaacgaacgcgatggcggcacgatctacaacacgcagctcctgttcgacgccgacggcaccttgatccagcgccggcgaaagatcacgccgaccttctacgaacgaatggtctggggacagggtgacggttcggggctgcgcgccgtcgacagccgcgtaggacgcatcggccagctcgcctgtttcgagcactacaacccgctggcgcgctacgccatgatggccgacggcgagcagattcactccgcgatgtaccccggctccatctttggagacgcattcgcgcagaaaatcgagatcaacatccgccagcacgcgctcgagtccggtgcgttcgtcgtcaacgccaccgcctggctcgatgccgaccagcaggcgcggatcatgaaggataccggctgcaccatcgaaccgatctcgggcggttgcttcaccgccatcgtcaccccggacgggaccctgctgggcgaagcgatacgttcgggggagggagtggtggtcgccgatctcgacttcacgctgatcgacaggcgcaagcaagtgatggactctcgtggtcactacagtcggccggagttgctcagccttctgatcgaccgcacacccaccgcacacctacacgaacgcgaagcgcaccccagagcaagtgaggactggcaaggttccgagagtctgcgcgccatgcaggcctcggcaccgaaggtctga

SEQ ID NO: 158 - protein, 336 aa, Unknown
  Obtained from an environmental sample
MRVVKAAAVQLSPVLYSREGTVEKVVRKIHELGDQGVEFATFPETVVPYYPYFSAVQTPIQNMHGPEHLKLLEQSVTVPSPATDAIGDACRHAGVVVSIGVNERDGGTIYNTQLLFDADGTLIQRRRKITPTFYERMVWGQGDGSGLRAVDSRVGRIGQLACFEHYNPLARYAMMADGEQIHSAMYPGSIFGDAFAQKIEINIRQHALESGAFVVNATAWLDADQQARIMKDTGCTIEPISGGCFTAIVTPDGTLLGEAIRSGEGVVVADLDFTLIDRRKQVMDSRGHYSRPELLSLLIDRTPTAHLHEREAHPRASEDWQGSESLRAMQASAPKV

SEQ ID NO: 159 - DNA, 930 bp, Unknown
  Obtained from an environmental sample
atgtcatcaaccgtgacggttgccattattcaggcagcacccgtgtattatgacctgcctgccacgctggacaaagccgccaaactggtggcggatgcggcggcacagggcgcaacgctgattgtcttcggcgagacatggtttccggggtatccggcatggctggattactgccccaatgtcgcgctgtggaatcatcccccgaccaagcaggtatttgagcgcctgcatcgcaacagcatcgctgtgccaagcaaggaactcgattttctgggggcgctggcacgcaagcatcaggtggtgctggtgttgagcattaatgaacgtgtggagcagggcgcggggcatggcacgctgtataacacgctgctcacgattgacgccgatggcacgctggcaaatcatcatcgcaaactgatgccgacctataccgagcgcatggtgtggggcatgggcgacggggtggggttgcaagcggtggatactgccgtcgggcgcgtaggcggcttaatctgctgggaacactggatgccgttggcacgccagaccatgcacatcagcggcgaacagattcatatttccgtcttcccaaccgtccatgagatgcaccagattgccagccgccagtatgcctttgaagggcggacgtttgtgctgaccgttggcggcattcttgcggcacaggacttgcccgccgaactggaacgccccgccgatttgccgcccacgcagcttgtccagcgcggcggcagcgccattatcgcgccggatggtcgttatctggcgggtccagtctataatgaggaaaccatcctgaccgcaacgctggatttgggcgagatcatccgcgagagcatgacgctggatgtcaccggacattatgcccgcccggatgtttttgacctgaccgtgaagcgcagccgaccatga

SEQ ID NO: 160 - protein, 309 aa, Unknown
  Obtained from an environmental sample
MSSTVTVAIIQAAPVYYDLPATLDKAAKLVADAAAQGATLIVFGETWFPGYPAWLDYCPNVALWNHPPTKQVFERLHRNSIAVPSKELDFLGALARKHQVVLVLSINERVEQGAGHGTLYNTLLTIDADGTLANHHRKLMPTYTERMVWGMGDGVGLQAVDTAVGRVGGLICWEHWMPLARQTMHISGEQIHISVFPTVHEMHQIASRQYAFEGRTFVLTVGGILAAQDLPAELERPADLPPTQLVQRGGSAIIAPDGRYLAGPVYNEETILTATLDLGEIIRESMTLDVTGHYARPDVFDLTVKRSRP

SEQ ID NO: 161 - DNA, 1008 bp, Unknown
  Obtained from an environmental sample
atgaccaccatccgcgccgccgccgtgcagtttagcccggtgctgtactcgcgccaggccaccgtcgacaagctgtgccgcaccctgctggaactgggccgcgaaggggtgcagttcgcggtattcccggaaaccgtggtgccgtactacccatatttttccttcgtgcagccaccgttcgccatgggcaaacaacacctgttgctgctcgagcaatccgtcactgtgccctctgacgtcacccggcagatcggtgaggcctgccgggaagcggggatcgtcgccagcatcggcgtcaacgaacgcgacggcggcactatttataacgcgcagttgctgttcgatgccgacggcagcctgattcagcagcggcgcaagatcaccccgacctatcacgaacgcatggtctgggggcagggcgatggttccggcctgcgcgccgtggacagtgcggtggggcgtatcggttccctggcctgctgggaacattacaaccccctggcgcgctacgcgctgatggccgatggcgaacagattcatgtggcgatgtttcccggctccctggtcggcgacatctttgccgagcagatcgaagtcaccatccgccaccacgccctggaaagcggctgcttcgtggtcaacgccacggcttggctggatgccgaccagcagggccggatcatgcaggacaccggctgcgagttggggccgatttccggcggctgttttaccgcgatcatttccccggagggcaaggttctcggcgagccgctgcgcagcggcgaaggggtggtcattgctgacctcgacctggccctgatcgacaagcgcaaacgcatgatggattcggtcggtcactacagccgcccggaactgctcagcctgcttatcgaccgcagcccgaccgcccacgtgcatgaacttgccgccgcgcttaatcctgccagggagtctgatccactagtgtcgacctgcaggcgcgcgagctccagcttttgttccctttag

SEQ ID NO: 162 - protein, 335 aa, Unknown
  Obtained from an environmental sample
MTTIRAAAVQFSPVLYSRQATVDKLCRTLLELGREGVQFAVFPETVVPYYPYFSFVQPPFAMGKQHLLLLEQSVTVPSDVTRQIGEACREAGIVASIGVNERDGGTIYNAQLLFDADGSLIQQRRKITPTYHERMVWGQGDGSGLRAVDSAVGRIGSLACWEHYNPLARYALMADGEQIHVAMFPGSLVGDIFAEQIEVTIRHHALESGCFVVNATAWLDADQQGRIMQDTGCELGPISGGCFTAIISPEGKVLGEPLRSGEGVVIADLDLALIDKRKRMMDSVGHYSRPELLSLLIDRSPTAHVHELAAALNPARESDPLVSTCRRASSSFCSL

SEQ ID NO: 163 - DNA, 978 bp, Unknown
  Obtained from an environmental sample
gtgaccatcatcaaagccgccgcagtgcagatcagccccgtgctttacagccgggaagccaccgtcgaaaaggtcgttcgcgagacccgcgaactcggccagaagggcgtgcagttcgcaacgtttccggaaaccgtggtgccgtactacccatacttctccgccgtccagacgggcatcgaactgctgtccggcaaagagcacctgcgactgctggagcaggccgtgactgttccttcccccgccactgatgcgattgcccaggcggcacgcgaggccggcatggtggtgtcgatcggcgtcaacgagcgtgacggcggcaccatctacaacacgcagctgctctttgatgccgacggcacgctggtgcagcgccgccgcaagatcacgccgacgcatttcgagcgcatggtgtggggccagggcgacggttcgggcctgcgcgcagtggataccaaggtcggccgcattggccagctggcctgcttcgagcacaacaacccgctcgcgcgctacgcaatgatggccgatggcgagcagatccattcctccatgtacccgggctccgccttcggcgacggattcgcgcagcgcatggagatcaacattcgccaacacgccctggagtcgggttgcttcgtggtgaatgccaccgcgtggctcgacgccgaccagcaggcgcagatcatgaaggacacgggctgcgccatcgggccgatctctggcggctgcttcacgaccatcgtcacgccggacggcatgctgatcggcgaacccctccgcgagggcgagggcgagatcatcgccgacctcgatttcaccctgatcgaccgccgcaagctgctgatggactcggtcggccactacaaccgtccggagctgctgagcctgctgatcgaccgcacacccgcggcgaacttccatgagcgcagtacgcatccggccgtcgatgccgccagcggcctcgaaatcctctaa

SEQ ID NO: 164 - protein, 325 aa, Unknown
  Obtained from an environmental sample
VTIIKAAAVQISPVLYSREATVEKVVRETRELGQKGVQFATFPETVVPYYPYFSAVQTGIELLSGKEHLRLLEQAVTVPSPATDAIAQAAREAGMVVSIGVNERDGGTIYNTQLLFDADGTLVQRRRKITPTHFERMVWGQGDGSGLRAVDTKVGRIGQLACFEHNNPLARYAMMADGEQIHSSMYPGSAFGDGFAQRMEINIRQHALESGCFVVNATAWLDADQQAQIMKDTGCAIGPISGGCFTTIVTPDGMLIGEPLREGEGEIIADLDFTLIDRRKLLMDSVGHYNRPELLSLLIDRTPAANFHERSTHPAVDAASGLEIL

SEQ ID NO: 165 - DNA, 1008 bp, Unknown
  Obtained from an environmental sample
atggccaatttcaaattcaaggcggcggcggtgcaggccgcgcccgctttcctcgatctcgaggctagcatcgccaagtcgatcgccctgatcgaacaagccgccgccaacggcgccaagctgatcgcctttcccgaagtcttcattcccggctacccctggcacatctggctcgacagtcccgcctgggcgatcgggcgcggcttcgtctcgcgctatttcgagaactcgctggactacaacagccccgaggccgagcgcctcaggctcgccgtcaagaaggcgggcctgacggcggtgatcggcctctccgagcgcgacggcggcagcctctacatcgcgcaatggatcatcggccctgacggcgagaccgttgcgaaacggcgtaagctccggccgacccattgcgagcgcacggtctatggagaaggcgacggcagcgacctcgcggttcacgacgtatctggcatcggccgtctcggcgcgctctgctgctgggagcatatccagccgctgtcgaaattcgcgatgtattcgcaaaatgagcaagtgcacgtcgcgtcctggccgagcttctcgctctacgacccgttcgcgccggcgctgggcgccgaggtcaacaacgcagcctcgcggatctatgcggtcgaaggctcatgcttcgtcattgcgccctgcgcgaccgtttcgcctgcaatgatcgaggaactgtgcgacgcgccaaacaaacatgcgcttctgcacgcgggcggcggcttcgcgcgcatctatgggccggacggcgcttcgatcgccgagacgctgccgccagatcaggaaggcttgatctacgccgacatcgacctcaccgcgatcggcgtcgccaaggccgccgccgatcccgccggccattattcgcgccccgacgtcacgcgcctgctcttcaacaagaagcccgctcggcgagtcgaaacttttgctttgcccgtcgatgcgccggcgccggagacgcagaccgccgcgagctga

SEQ ID NO: 166 - protein, 335 aa, Unknown
  Obtained from an environmental sample
MANFKFKAAAVQAAPAFLDLEASIAKSIALIEQAAANGAKLIAFPEVFIPGYPWHIWLDSPAWAIGRGFVSRYFENSLDYNSPEAERLRLAVKKAGLTAVIGLSERDGGSLYIAQWIIGPDGETVAKRRKLRPTHCERTVYGEGDGSDLAVHDVSGIGRLGALCCWEHIQPLSKFAMYSQNEQVHVASWPSFSLYDPFAPALGAEVNNAASRIYAVEGSCFVIAPCATVSPAMIEELCDAPNKHALLHAGGGFARIYGPDGASIAETLPPDQEGLIYADIDLTAIGVAKAAADPAGHYSRPDVTRLLFNKKPARRVETFALPVDAPAPETQTAAS

SEQ ID NO: 167 - DNA, 1017 bp, Unknown
  Obtained from an environmental sample
atgggtattgaacatccgaagtacagggttgccgtggtgcaggccgcaccggcctggctcgatcttgacgcgtcgatcgacaagtcgatcgcgctgatcgaggaggctgcccagaaaggcgccaagctgatcgcattccccgaggccttcatccccggctacccctggcatatctggatggactcgcccgcctgggcgattggccgcggttttgtgcagcgctacttcgacaattcgctggcctatgacagcccgcaggccgagaagctgcgcgcggccgtgcgcaaggcaaaactcacggccgtgatcggcttgtcggagcgtgacggcggcagcctttatctcgcacaatggctgatcggccccgacggcgagaccatcgcaaaacggcgcaagctgcggccgacacatgccgagcgcactgtgtacggcgagggcgacggcagcgaccttgcggtccacaatcgtccggacatcggcaggctcggtgcgctctgctgctgggagcatcttcagccactgtcgaaatacgcgatgtacgcgcagaacgagcaggtgcacgtcgcggcctggccgagcttttcgctctacgatcccttcgccgtggcgctcggcgccgaggtgaacaacgcggcctcccgcgtctatgcggtcgaaggctcctgcttcgtgctggcgccgtgcgcgacagtctcgcaagccatgatcgacgagctctgcgatcggccggacaagcacgcgctgctgcatgtcggcggcggctttgccgcgatctacgggcccgacggcagccagatcggcgacaagctcgcccccgaccaggagggcctgttgatcgccgagatcgatctcggcgccataggtgtcgccaagaacgccgcggatcccgccgggcactattcgcggcccgacgtgacgcggctgttgctcaacaagaaaccgtacaagcgcgtcgaacagttctcgccgccgtcggaggcggttgaacccacggatatcgcggcggcggcaagctga

SEQ ID NO: 168 - protein, 338 aa, Unknown
  Obtained from an environmental sample
MGIEHPKYRVAVVQAAPAWLDLDASIDKSIALIEEAAQKGAKLIAFPEAFIPGYPWHIWMDSPAWAIGRGFVQRYFDNSLAYDSPQAEKLRAAVRKAKLTAVIGLSERDGGSLYLAQWLIGPDGETIAKRRKLRPTHAERTVYGEGDGSDLAVHNRPDIGRLGALCCWEHLQPLSKYAMYAQNEQVHVAAWPSFSLYDPFAVALGAEVNNAASRVYAVEGSCFVLAPCATVSQAMIDELCDRPDKHALLHVGGGFAAIYGPDGSQIGDKLAPDQEGLLIAEIDLGAIGVAKNAADPAGHYSRPDVTRLLLNKKPYKRVEQFSPPSEAVEPTDIAAAAS

SEQ ID NO: 169 - DNA, 1077 bp, Unknown
  Obtained from an environmental sample
atggccctcacccatccgaaattgaaagtcgccgccgtgcaggcagctcccgcgttcctcgatgtcgatgccgcagtggacaaagcggtgcggctaatcgacgaagcggcagcaaacggctccagtctggtggcattccccgagacctggatccccggctatccgttttggatctggcttggctcgccggcctgggcaatcatgcgcgggtttgtgtctcgctatttcgataattcgctcagctatgacagccggcaggcagagcgcctgcgcgacgccgcgaagcgccacaaactgaccgtcgtcatgggcctgtccgagcgcgccggcggtagcctttacatcgcgcagtggatcattggtcccaatggcgagaccgtcgcacagcggcgcaagctcaagcccacccatgcggagcgcaccgtcttcggcgagggtgacggcagccacctggcggtacacaatcttccaatcggacggctcggtgcgctgtgctgctgggagcacctccagccgctctccaaatacgcgatgtacgcccagaacgaagagatccacgtggcggcatggccgtccttctcgctctacgacccgtttgcgcacgcgctcggcgccgaagtcaacaacgcagcgagccagatctacgcggttgaaggttcctgctttgtcgtcgcgccatgtgcggtgatctcgcaggaaatgatcgatcttatgtgcgatacccccgacaagcatcagcttattcacgtcggtggcggcttcaccgtgatctatggcccggacggtgcgcgcatcggcgacaagctcgcgccagatcaggaaggcattgtctatgccgacatcgatctcggcatgatcccgatcgcgaaagctgccgccgatcctgccggccactatgcgcgacccgacgttacccgccttctgttcaacaatcgtcccgccaatcgggtggaaaccctcgtgctccccgttgatcaggtccgtgacatcgatgcacgtgtggaggccgcggcacctcaggcgcgaccagcaaccgggaacgaggatcccgccgcaaagcctatggccgccgaatga

SEQ ID NO: 170 - protein, 358 aa, Unknown
  Obtained from an environmental sample
MALTHPKLKVAAVQAAPAFLDVDAAVDKAVRLIDEAAANGSSLVAFPETWIPGYPFWIWLGSPAWAIMRGFVSRYFDNSLSYDSRQAERLRDAAKRHKLTVVMGLSERAGGSLYIAQWIIGPNGETVAQRRKLKPTHAERTVFGEGDGSHLAVHNLPIGRLGALCCWEHLQPLSKYAMYAQNEEIHVAAWPSFSLYDPFAHALGAEVNNAASQIYAVEGSCFVVAPCAVISQEMIDLMCDTPDKHQLIHVGGGFTVIYGPDGARIGDKLAPDQEGIVYADIDLGMIPIAKAAADPAGHYARPDVTRLLFNNRPANRVETLVLPVDQVRDIDARVEAAAPQARPATGNEDPAAKPMAAE

SEQ ID NO: 171 - DNA, 1011 bp, Unknown
  Obtained from an environmental sample
atgactaagggaacagtgaaagtcgcggcggcgcaggtcacccccgtgttcatggatcgtaaagccacgatcgtcaaggcctgcgacacgatcgccgaggcgggcaagaacggcgcgcggctggtggtgttcccggagacgtttgttcctggctacccggactgggtctggacggcgacggctgggacgcatcgcgatatccaccaggcgatgtacgcggaactgctggaccaggctgtctcgattccgagcccggcgacggacgccctctgccgtgctgcaaagaaggcgggcgtctacgtcgtcatcggcgtcaatgagctgagtgggccgggcggaagcctgtacaacacgctgatctacatcgatgacgaaggcgagatcatgggccgccaccgcaagctggtccccacgatgggcgagcgcctggtctgggcacccggcgacggcagcacgctggaggcgtacgagacatcgatcggcaggctgggcggactgatctgctgggagaactacatgccgctggcccgctacgccatgtacgcctggggcgtgcagatctacgtcgcgccgacgtgggacagctcggacgggtgggttggcagcatgcagcacatcgcccgcgaagggcggacggcggtgatcggctgctgcatggcgatccgtcgcagcgacatcccggacaagtacgagttcaagaagctgtacccgccgagcaagagcaaagacgaagaatgggtgaacgatggcaacagcgtcatcgtcgcacccggtggacgaatactcgccgggccggtcgccaaagaggagacgatcctctacgccgatctggacccggcagccgagcgcggttcaaagttctcgttagatgtggcagggcactacgcgcggccggacgtcttccagctgacggtgaatcgcggtccggcagaactggtgaatgtggccggtgatatcgcaccggcaaccaacggcaaagtcaaaacaccggcgaaattacgccgcaagtaa

SEQ ID NO: 172 - protein, 336 aa, Unknown
  Obtained from an environmental sample
MTKGTVKVAAAQVTPVFMDRKATIVKACDTIAEAGKNGARLVVFPETFVPGYPDWVWTATAGTHRDIHQAMYAELLDQAVSIPSPATDALCRAAKKAGVYVVIGVNELSGPGGSLYNTLIYIDDEGEIMGRHRKLVPTMGERLVWAPGDGSTLEAYETSIGRLGGLICWENYMPLARYAMYAWGVQIYVAPTWDSSDGWVGSMQHIAREGRTAVIGCCMAIRRSDIPDKYEFKKLYPPSKSKDEEWVNDGNSVIVAPGGRILAGPVAKEETILYADLDPAAERGSKFSLDVAGHYARPDVFQLTVNRGPAELVNVAGDIAPATNGKVKTPAKLRRK

SEQ ID NO: 173 - DNA, 993 bp, Unknown
  Obtained from an environmental sample
atgaaagttgttaaagccgccgcagtccaactgagtcccgtcctctatagccgcgagggaacggtcgagagggtcgttcggaagatccacgagcttggccggcagggggtacagttcgccaccttcccggagaccgtagtgccttactacccgtacttttccttcgtccagacgcccttacagattatagccggacctgagcatctaaagctgctcgaccaggcagtgaccgtgccgtcccctgccaccgacgctatcagcgaggctgccaggcaggcgggagttgtggtgtccataggcgtcaacgagcgtgacggcggaaccctgtacaacacgcagctgctcttcgatgccgatggcgccttgatccagcgccgccgcaagattacgcccactcatttcgagcgcatgatctggggccagggcgacgggtcgggcctgcgcgctgtcgacagcaaggtcggtcgcattggccagctcgcatgctgggagcacaacaaccccctggcgcgctacgcgatgatagccgacggcgagcagatccattcggcaatgtatccgggctccatgttcggcgacccgtttgcccagaagacggaaatcaatatccggcagcatgcattggagtctgcgtgcttcgtcgtgtgcgccacggcctggctggacgccgatcagcaggcgcaaatctgcaaggacactggctgcgacatcggcccgatctccggcggttgcttcaccgcgatcgtggcgcctgatggaaccttgctgggcgagcccatccgctcgggcgaaggcatggtcatcgtcgacctcgacttcacgctcatcgacaagcgcaagcaggtgatggactcgcgcggccactacaaccggccggaattgctcagtctcctgatcgaccgcacacccactgcgcatgttcacgaccgcgctgtgcgccccgagtcagccgcggagcaacgttcggaggaacttctcgctacggctgtctaa

SEQ ID NO: 174 - protein, 330 aa, Unknown
  Obtained from an environmental sample
MKVVKAAAVQLSPVLYSREGTVERVVRKIHELGRQGVQFATFPETVVPYYPYFSFVQTPLQIIAGPEHLKLLDQAVTVPSPATDAISEAARQAGVVVSIGVNERDGGTLYNTQLLFDADGALIQRRRKITPTHFERMIWGQGDGSGLRAVDSKVGRIGQLACWEHNNPLARYAMIADGEQIHSAMYPGSMFGDPFAQKTEINIRQHALESACFVVCATAWLDADQQAQICKDTGCDIGPISGGCFTAIVAPDGTLLGEPIRSGEGMVIVDLDFTLIDKRKQVMDSRGHYNRPELLSLLIDRTPTAHVHDRAVRPESAAEQRSEELLATAV

SEQ ID NO: 175 - DNA, 945 bp, Unknown
  Obtained from an environmental sample
atgaccacctacgggcagtttagacttgccgcgatcaatgccgcgcctgtctacttcgacagggaagcatccaccgaaaaagcttgccggctcattctcgaagcgggggcatcaggggcgacgctggcggcgtttggcgagacgtggcttcccggctatccattccacatctggagggaagttccgactgctctccgagtggaatacatcgctaatgccgtcgagattcccagcccaacgaccgaccgattgtgcgcggcggctcgtcaggcgaacatcgatgttgtgatcggcgttgtcgaactggatgcgcagacacacgggacggtctactgtacgctcttgttcattggcagcgatggctcaattctgggacgtcatcgaaagattaaaccgactttcgtggagcgaaccgcatggggggaaggtgacggcagcagcctgatcgtctacgagcgcccgtatggcaagatcagtggtctgtgttgctgggaacacaatatggttctgccgggctacgcgctgatggcgcaggggacgcagattcatatcgccgcatggcccggctgggaaagcactcgccatctgctcttatcaagagcattcgcttctcaggcagcggcgtatgtgattgatgtaggcgctatcgtcaatcgtgacgaccttcgggaagattaccaggctttgattgctggaagctactggggcggaagttgcatcatcaacccagaaggcgaggtcatcgctggtccagcgaaatcggagaccattctggttgcagattgctcaaccgagcagatctttagctcaaaagtgctctgtgatgtgggcgggcattattctcgcccggatatttttcagctccatgtcaatcgaaagccatatcaacgtatcgtcgagacgaacaacccacaccccgctccgattgagttcgattaccgttga

SEQ ID NO: 176 - protein, 314 aa, Unknown
  Obtained from an environmental sample
MTTYGQFRLAAINAAPVYFDREASTEKACRLILEAGASGATLAAFGETWLPGYPFHIWREVPTALRVEYIANAVEIPSPTTDRLCAAARQANIDVVIGVVELDAQTHGTVYCTLLFIGSDGSILGRHRKIKPTFVERTAWGEGDGSSLIVYERPYGKISGLCCWEHNMVLPGYALMAQGTQIHIAAWPGWESTRHLLLSRAFASQAAAYVIDVGAIVNRDDLREDYQALIAGSYWGGSCIINPEGEVIAGPAKSETILVADCSTEQIFSSKVLCDVGGHYSRPDIFQLHVNRKPYQRIVETNNPHPAPIEFDYR

SEQ ID NO: 177 - DNA, 948 bp, Unknown
  Obtained from an environmental sample
atggactcacttaccgttggtctcgcgcaaatcgcgcccgtttggttgaatcgggcggggacgttgtcaaagatgttggaacaggttcgagcggcgaaagaggcgggctgtcagcttgttgtgtttggtgaggcgttgctccccggttatccattttggatcgaactgacgaacggcgcagtcttcaattcgccgatgcaaaaggaaatccacgcgcactacatggatcaagctgtgcagatcgaagcagggcatcttgatccattgtgcggcgcggcaaaagcgcacggcatcaccgtggtcgcgggcatcatcgagcgtccgttggatcgcggcggacatagtttatatgcgagtctggtgtatatcgatttgaacggtgtcatccaatcggtgcatcgcaaactgatgcccacctatgaagaacgactcacctggtcgcctggcgatggtcatgggttacgcgtgcatacactgggcgcttttacggttggcaaactcaattgttgggaaaactggatgccgctgccgcgcgcggctctgtatgcgcaaggcgaagatctgcacgttgctgtctggcccgggtccgtgcgcaacacacaggatattacgcgctttatcgcaatggagtcgcgatcgtttgtcgtttcggtttcgagtttgatgcgcaagagtgacttcccacaagatacgcctcatctctccgccattcttgaatctgcacccgatccactcgccaacggaggttcgtgtctggctggacctgacggtaaatggatcgttgaaccggttgcggatgaagagaagttgatcgtcgccaccattgaccatgcccgtgtacgtgaagaacgccagaactttgatccatccggtcattacagccgaccagatgtgacacaattgagagtcaaccgccagcgacaaagcgttatcgcttttgatgagtag

SEQ ID NO: 178 - protein, 315 aa, Unknown
  Obtained from an environmental sample
MDSLTVGLAQIAPVWLNRAGTLSKMLEQVRAAKEAGCQLVVFGEALLPGYPFWIELTNGAVFNSPMQKEIHAHYMDQAVQIEAGHLDPLCGAAKAHGITVVAGIIERPLDRGGHSLYASLVYIDLNGVIQSVHRKLMPTYEERLTWSPGDGHGLRVHTLGAFTVGKLNCWENWMPLPRAALYAQGEDLHVAVWPGSVRNTQDITRFIAMESRSFVVSVSSLMRKSDFPQDTPHLSAILESAPDPLANGGSCLAGPDGKWIVEPVADEEKLIVATIDHARVREERQNFDPSGHYSRPDVTQLRVNRQRQSVIAFDE

SEQ ID NO: 179 - DNA, 915 bp, Unknown
  Obtained from an environmental sample
atgaccaccaaagcagccatcattcaggcgcgccccatatactacgatctggcggcgtgtgtcgataaggcgcttgccctcatcaccgaggcggcggcacgcggcgcgaacatcgtcacgctcggcgagacgtggctgccgggctatcccgcgtggctggatgtgtgcgtcgagatggggctgtgggatcacgcgccgaccaaagccgtctttcagcggctccatgccaacagcgtcaccatccccggcgcggagatcagccagttctgcgacatcgcccgccgccttagcatcgtgctggtgctcagcgtcaacgagcgcgtccgcaacaccttgttcaacaccctgctcacgattgacgagcgcggcgacatccgcaaccaccaccgcaagctgatgccgacctacactgagcgcatcgtctgggggcagggcgacggcgcgggcttacaggcggtcgagacggcaaccgggcgcgtcggcgggctgatctgctgggaacactggatgccgctggcacggcaggcgctgcacaacgccggggagcaaattcacgtttcggtcttcccgaccgtcaacgacccgcgccaccaagtcgccagccgccagtacgctttcgaggggcgctgcttcgtgctgaccgccggcagcatccagcgcgccgacgacctaccgccggaactgaccgtcaaggcgggcatcgcgccggatgatctggtgcagggcggcggcagcgccatcatcgcgccggacatgcgctacctcgccggaccctgcttcgacgaggaaaccatcctctacgccgacctcgacctgagcgagacgatccgcgagagcatgacgctggacgtgagcgggcattactcgcgccccgacgtgttcaccttcgaggttaatcggcagcggaaaatttag

SEQ ID NO: 180 - protein, 304 aa, Unknown
  Obtained from an environmental sample
MTTKAAIIQARPIYYDLAACVDKALALITEAAARGANIVTLGETWLPGYPAWLDVCVEMGLWDHAPTKAVFQRLHANSVTIPGAEISQFCDIARRLSIVLVLSVNERVRNTLFNTLLTIDERGDIRNHHRKLMPTYTERIVWGQGDGAGLQAVETATGRVGGLICWEHWMPLARQALHNAGEQIHVSVFPTVNDPRHQVASRQYAFEGRCFVLTAGSIQRADDLPPELTVKAGIAPDDLVQGGGSAIIAPDMRYLAGPCFDEETILYADLDLSETIRESMTLDVSGHYSRPDVFTFEVNRQRKI

SEQ ID NO: 181 - DNA, 990 bp, Unknown
  Obtained from an environmental sample
atgcccaagaccgtacgcgcagccgcagtccagatcgcgcccgacctgacgtcacgcgctggcaccgtcgagcgggtcctgaatgcgattgccgaagcctctgacaaaggcgcggagctgattgtatttccagaaacctttgtgccttggtatccgtatttcagcttcgttctgccgcctgtccagcagggacccgagcacctgcggctttatgaagaagcggtgacggtaccatcagcagaaacacgggccgtcgccgacgccgcgcgcaaacgcaatgcggtcatcgtccttggcgtcaatgagcgcgaccacggctcgctctacaacacccagctgatcttcgacgcggatggcagcctgaaactcaagcgccgcaagatcacgcccacctatcacgagcggatgatctggggacagggcgatggcgccggtctaaaagtggtcgaaactgccatcggccgcatgggcgcattggcgtgctgggagcactacaaccccctcgcccgatacgcgctgatggctcagcatgaggaaattcacgcctctcattttccgggctcactggtcggcccgatattcggcgagcagatcgaagtcacgatgcgccaccacgcgttggaatcgggctgtttcgtggtcaatgccaccggctggttaagcgaggagcagatcgcgtccattcacccagatcccagcctgcagaagggtcttcgagatggctgcatgacctgcatcataaccccggaaggccgccacgtcgttcctcctctgacatcgggtgaaggaatcctgattggcgacctggacatgcggctcatcaccaagcgcaagcgaatgatggattccgtcggacactatgcacgtcctgagctgctgcaccttgtccatgacacgacgcccgcacgcgcacgcgagcaggtgggcctttcaggcgatttttccgatgcagggcaagacaagctatttgaggaggttcaagatgcgtga

SEQ ID NO: 182 - protein, 329 aa, Unknown
  Obtained from an environmental sample
MPKTVRAAAVQIAPDLTSRAGTVERVLNAIAEASDKGAELIVFPETFVPWYPYFSFVLPPVQQGPEHLRLYEEAVTVPSAETRAVADAARKRNAVIVLGVNERDHGSLYNTQLIFDADGSLKLKRRKITPTYHERMIWGQGDGAGLKVVETAIGRMGALACWEHYNPLARYALMAQHEEIHASHFPGSLVGPIFGEQIEVTMRHHALESGCFVVNATGWLSEEQIASIHPDPSLQKGLRDGCMTCIITPEGRHVVPPLTSGEGILIGDLDMRLITKRKRMMDSVGHYARPELLHLVHDTTPARAREQVGLSGDFSDAGQDKLFEEVQDA

SEQ ID NO: 183 - DNA, 1002 bp, Unknown
  Obtained from an environmental sample
atggctgagtcacgcattattcgtgccgccgccgcccagattgcgccagatctccatgaggccagcaaaacgctggcccgggtgctggacgcgatcgatcaggcagccgcacagggggcagagatcatcgtctttcccgagacctttgtgccttattacccctacttctcgtttatcacgcccgcgatgaccgccggagcggcccatctgaaattgtatgaccaggcggtggtggtgcccggcccgatcacccatgcggtgggcgaacgcgcccgcctgcgcaacatcgtcgtggtgctgggggtgaatgaacgtgaccacggcacgctctacaacacccaactggtatttgatgccagcggggaactggtgctgaaacgccgcaaaatcaccccgacctatcacgaacggatgatctggggacagggagacggtgccggattaaaggtggtggactcggcggttgggcgcatcggggctttagcctgctgggagcactacaacccactggcgcgctacagcctgatgactcagcacgaggagatccattgcagccagttccctggttcactggtggggccgatttttgccgagcagatggacgtcaccattcgccatcatgcactggagtccggttgctttgtcatcaatgccaccggctggctgaccgaggagcagatcaacgagctgaccagcgacccggcgttacaaaaggggctgcgtggtggctgcaacaccgccatcatctcgccggaaggccgccatctggtgccgccactgaccgaaggtgaggggattttgattgccgatctggacatggccctgatcaccaaacgcaaacgcatgatggattctgtcggccactatgcccgaccggaattactcagcctgcgcctcgatgcgacgcctgcccgttatgtggtggcgcgtgataatgagtccgaaaccggaggaggcaacgatgcagaacgtaccgtctacgcgccagcagctgatcactga

SEQ ID NO: 184 - protein, 333 aa, Unknown
  Obtained from an environmental sample
MAESRIIRAAAAQIAPDLHEASKTLARVLDAIDQAAAQGAEIIVFPETFVPYYPYFSFITPAMTAGAAHLKLYDQAVVVPGPITHAVGERARLRNIVVVLGVNERDHGTLYNTQLVFDASGELVLKRRKITPTYHERMIWGQGDGAGLKVVDSAVGRIGALACWEHYNPLARYSLMTQHEEIHCSQFPGSLVGPIFAEQMDVTIRHHALESGCFVINATGWLTEEQINELTSDPALQKGLRGGCNTAIISPEGRHLVPPLTEGEGILIADLDMALITKRKRMMDSVGHYARPELLSLRLDATPARYVVARDNESETGGGNDAERTVYAPAADH

SEQ ID NO: 185 - DNA, 1017 bp, Unknown
  Obtained from an environmental sample
atgggcattgaacatccgaaatacaaggtcgcggtggtgcaggcggcccccgcctggctcgatctcgacggctcggtcgataagtcgatcgcgctgatcaaggaggcggccgagaagggggcgaagctgatcgcctttcccgaggccttcatccccggttacccctggcatatctggatggactcgccggcctgggcgatcggccgcggcttcgtgcagcgttatttcgacaattcgctgtcctatgacagtccgcaggccgagcggctgcgcgatgcggtgaagaaggcgaagctcaccgccgtgttcggactgtccgagcgcgacggcggcagcctctacctcgcgcaatggctgatcgggcccgatggcgagaccatcgccaagcgccgcaagctgcggccgacccacgccgaacgtaccgtctatggcgaaggcgacggcagcgatcttgccgtgcatgcgcgcgccgacatcggccggatcggcgcgctctgctgctgggagcatctgcagccactgtcgaaatacgcgatgtacgcccagaacgaacaggtccatgtcgcagcctggcccagcttctcgctgtacgaccccttcgcgccggcgttaggggccgaggtcaacaacgcggcctcccgcgtctatgcggtggaaggctcctgcttcgtgctcgcgccgtgcgcgacggtgtcgcaggcgatgatcgacgagctctgcgaccggcccgacaagaacgcgctgctgcacgtcggcggcggctttgccgcgatctatggccccgacggcagccagatcggcgacaagctggcgccggaccaggaggggctgctgatcgccgagatcgaccttggcgccatcggtgtcgccaagaacgccgccgatcccgccgggcactattcgcgtcccgacgtgacgcggttgctgctcaacaagaagcgataccagcgcgtcgagcagttcgcgctgccggtcgacaccgtcgagccggcggatatcggcgcagcggcgagctga

SEQ ID NO: 186 - protein, 338 aa, Unknown
  Obtained from an environmental sample
MGIEHPKYKVAVVQAAPAWLDLDGSVDKSIALIKEAAEKGAKLIAFPEAFIPGYPWHIWMDSPAWAIGRGFVQRYFDNSLSYDSPQAERLRDAVKKAKLTAVFGLSERDGGSLYLAQWLIGPDGETIAKRRKLRPTHAERTVYGEGDGSDLAVHARADIGRIGALCCWEHLQPLSKYAMYAQNEQVHVAAWPSFSLYDPFAPALGAEVNNAASRVYAVEGSCFVLAPCATVSQAMIDELCDRPDKNALLHVGGGFAAIYGPDGSQIGDKLAPDQEGLLIAEIDLGAIGVAKNAADPAGHYSRPDVTRLLLNKKRYQRVEQFALPVDTVEPADIGAAAS

SEQ ID NO: 187 - DNA, 1059 bp, Unknown
  Obtained from an environmental sample
atgggcatcaatcatcccaagtacaaagtggccgtcgtgcaagcggcacctgtctggctcgacctggatggaacagtcgacaagtgcattcggctgataggcgaggccgctgagaagggatgcaagctcattgcatttcccgagacgttcatcccggggtacccctggcacatctggatgggagctccggcctggacgatcgggcgcggattcgtgcagcgatacttcgacaattcgcttgcgtacgacagtccgcaggcaaacaagcttcgcgccgcggtgaagcgcgccggagtgacggcagttctcggcttgtcggagcgccgcggaggctccctgtacatcgcccagtggctcatcggacctgatggcgagaccatcgctcaacggcgaaagctgcgccccacccatgcggagcgcaccgtcttcggcgagggcgatggcagcgatttggcggtgcacagccgccccgacatcggccgactgggtgccctttgctgctgggaacatctccagcctttgaccaagtacgcgatgtacgcgcaagacgagcaagtgcacgtcgctgcatggccgagcttctcgatgtacgagcctttcgcgcacgccctggggtgggagacgaacaacgcggtgagcaaggtgtacgcggtcgaaggttcgtgctacgtcctggccccctgcgccatcatctctcaggcgatggtggacgaactcgtcgacagcgaggacaagaagccgctggttcatgccggcggggggcatgcggtgatctatggtcccgatggcaccctgcttactcccaagcttgcagaagacgaggagggcctactgatcgcggagatcgatctgggggcaatcggggtcgccaagaacgcggcagaccccgccggccactactcgcggcccgatgtcacccgcctgctcttcaacaaccggccggccaagcgcgtggagacgatgctgctcccggtcgacgcggcagaagtcgtggagccggcggacggagcgctcaatgcgtccgagggacgccagcgacagttcaagctgcccgcctag

SEQ ID NO: 188 - protein, 352 aa, Unknown
  Obtained from an environmental sample
MGINHPKYKVAVVQAAPVWLDLDGTVDKCIRLIGEAAEKGCKLIAFPETFIPGYPWHIWMGAPAWTIGRGFVQRYFDNSLAYDSPQANKLRAAVKRAGVTAVLGLSERRGGSLYIAQWLIGPDGETIAQRRKLRPTHAERTVFGEGDGSDLAVHSRPDIGRLGALCCWEHLQPLTKYAMYAQDEQVHVAAWPSFSMYEPFAHALGWETNNAVSKVYAVEGSCYVLAPCAIISQAMVDELVDSEDKKPLVHAGGGHAVIYGPDGTLLTPKLAEDEEGLLIAEIDLGAIGVAKNAADPAGHYSRPDVTRLLFNNRPAKRVETMLLPVDAAEVVEPADGALNASEGRQRQFKLPA

SEQ ID NO: 189 - DNA, 1005 bp, Unknown
  Obtained from an environmental sample
atgcaagacacgaaattcaaagttgcagtcgtccaggccgcgccggtattcatggatgcgccagcctccgtggccaaggcgatcggtttcatccaggaggcgggcgcagccggggcgaagctgctggcgttcccggaggtctggattccgggctacccttggtggctttggctcgggacgccggcgtggggaatgcagtttgtgccgcgctatcacgccaattcgctgcgtgctgatggacccgaaatcctcgctctttgtgcggccgccgccgaagcgaagatcaacgtcgtgatgggcttctccgaaatcgacggaggaacgctctacctaagtcaggttttcatcagcgatgcgggcaagatcatcttcaagcgccgaaagctcaagccgacccacgtcgaacgtacgctatttggtgaaggagatgggtctgatttccgagtcgtcgacagcagcgtcgggcgcctcggagccctgtgctgtgccgaacacattcagccgttgtcgaaatacgccatgtacgcgatgaacgagcaaattcatgtggcgtcgtggccatctttcacgctctatcgcggcaaagcctacgctttgggtcatgaggtgaatcttgccgccagccaaatctacgcgctcgaaggaggttgcttcgtcttgcatgccacggcaattaccggtcaggatatgttcgacatgctttgcgacactccggaaagggcggatttgctgaatgcggagggagcaaagccgggtggaggctattcgatgatttttggtcccgatggtcagccgatgtgcgagcatctgccgcaggacaaggaaggcatcctctatgccggcgtagacctgtcgatgattgcgatcgccaaagcggcctacgatcctacggggcactacgcccgcggtgatgtcgtccgtctcatggtcaaccgcagcccccgtcgcacgagcgtcagcttcagcgaagacgagaacgcggcggtcactttcaccgagacctga

SEQ ID NO: 190 - protein, 334 aa, Unknown
  Obtained from an environmental sample
MQDTKFKVAVVQAAPVFMDAPASVAKAIGFIQEAGAAGAKLLAFPEVWIPGYPWWLWLGTPAWGMQFVPRYHANSLRADGPEILALCAAAAEAKINVVMGFSEIDGGTLYLSQVFISDAGKIIFKRRKLKPTHVERTLFGEGDGSDFRVVDSSVGRLGALCCAEHIQPLSKYAMYAMNEQIHVASWPSFTLYRGKAYALGHEVNLAASQIYALEGGCFVLHATAITGQDMFDMLCDTPERADLLNAEGAKPGGGYSMIFGPDGQPMCEHLPQDKEGILYAGVDLSMIAIAKAAYDPTGHYARGDVVRLMVNRSPRRTSVSFSEDENAAVTFTET

SEQ ID NO: 191 - DNA, 945 bp, Unknown
  Obtained from an environmental sample
atgaaaaagttagctgtggttcaacgtgcgtcaggatttttagataagcagcagagcatcgcgttggcggtggaaagtattcagtctgctgcgaataatggcgcagagcttgttgtttttacggaagcctttattcctggttatcctgtctggttatggcgtctgcgccctggcaaagactgggggacaacagacagtctttatcaacgcttaataagcaacgcggttgatttaagctcatcggatttggatccgatttatgaagcggcaaaacgtcatcacgtcacggttgtatgcggcattaatgaacgcgactccagcgtcagccgaacaacgctatacaacacttacatcacggtttgtcatgagggcaatctcatcaatgttcatcgaaaactgatgccgaccaacccagagagaatggtgtggggctttggtgatgcgactggattaagggtagtagacactcctgtcggaaggattggctcactcgtttgctgggagaactacatgccgttggcacgctatgcactttatgctcagggcgtcgaaatttacattgcgcctacttatgacagtggctcggactggactgaaagcttgcgccatatcgccagagagggcagatgctacgttgtcggcagcggtaacttgttgagagccagcgacctgcctgatgattttccagaaaaagaaaccctctatcctgataaagacgagtggattaacggcggagactctaccgttatcgctcccggcggtgaaacattagttgctccgctgcatgcagaggaaggcatactgtattgcgatattgatactgataaagtggcggcggctcggcgttctttcgacgttgcaggccattactctcgcccagacatatttacactcaacgtaaatcgagcgccgcaaacatctctgcgtatcagggaagccgagtaa

SEQ ID NO: 192 - protein, 314 aa, Unknown
  Obtained from an environmental sample
MKKLAVVQRASGFLDKQQSIALAVESIQSAANNGAELVVFTEAFIPGYPVWLWRLRPGKDWGTTDSLYQRLISNAVDLSSSDLDPIYEAAKRHHVTVVCGINERDSSVSRTTLYNTYITVCHEGNLINVHRKLMPTNPERMVWGFGDATGLRVVDTPVGRIGSLVCWENYMPLARYALYAQGVEIYIAPTYDSGSDWTESLRHIAREGRCYVVGSGNLLRASDLPDDFPEKETLYPDKDEWINGGDSTVIAPGGETLVAPLHAEEGILYCDIDTDKVAAARRSFDVAGHYSRPDIFTLNVNRAPQTSLRIREAE

SEQ ID NO: 193 - DNA, 966 bp, Unknown
  Obtained from an environmental sample
atgtcaaacgagaaccacaaccaaacattcaaagttgccgcggtgcaggccacacctgtattcctcgatcgtgaagcgaccatcgacaaagcttgtgagttgattgctgcagccggcaatgaaggagcgcggctggttgtcttcccggaggcattcatcccatcctacccagattgggtatgggcaatcccaccgggcgaagaaggcgtgctcaatgagttgtacgcggaactgctctccaattcggtcacgattcccagtgatgtgacggatagactgtgccgagccgcgagacttgccaatgcctacgtagtgatggggatgagcgaacgcaatgccgaggccagtggcgcaagcctgtataacacgctgttgtacatcgatgcgcagggcgagattctgggcaaacatcgaaagctggtgcccacaggcggcgaacggctggtgtgggcgcagggcgatggcagcacgctgcaggtctacgatactccactgggtaaactcggcggtttgatttgctgggagaattatatgccgctggcccgctacaccatgtacgcatggggcacacaaatctatgttgcggcgacatgggatcgcgggcaaccctggctctccactttacggcatatcgccaaagaaggcagggtgtacgtgatcggctgctgtatcgtgatgcgcaaagacgatatcccagatcgttacccgatgaagcagaagttttacgcggaggccgatgagtggatcaacataggggacagcgcaatcgtcaatcctgaagggcagtttagcgccgggccggtacgcaaacaggaagagattctctacgcggaaattgatccgcgcatggtgcaaggcccgaagtggatgctcgacgtagcagggcactacgcgaggccggacgtattccagttgacggtgcatacggatgcgaggcagatgatcaggttggaacacgatgtttaa

SEQ ID NO: 194 - protein, 321 aa, Unknown
  Obtained from an environmental sample
MSNENHNQTFKVAAVQATPVFLDREATIDKACELIAAAGNEGARLVVFPEAFIPSYPDWVWAIPPGEEGVLNELYAELLSNSVTIPSDVTDRLCRAARLANAYVVMGMSERNAEASGASLYNTLLYIDAQGEILGKHRKLVPTGGERLVWAQGDGSTLQVYDTPLGKLGGLICWENYMPLARYTMYAWGTQIYVAATWDRGQPWLSTLRHIAKEGRVYVIGCCIVMRKDDIPDRYPMKQKFYAEADEWINIGDSAIVNPEGQFSAGPVRKQEEILYAEIDPRMVQGPKWMLDVAGHYARPDVFQLTVHTDARQMIRLEHDV

SEQ ID NO: 195 - DNA, 993 bp, Unknown
  Obtained from an environmental sample
atgaaagtcgtcaaagccgccgcggtacagttcagcccggtgctctatagccgtgaggcaaccgtcgccaaggtcgtgcagaagatccacgaactcggccagaaaggcgtgcagttcgccaccttccccgaaacggtcgtgccttattacccttactttgcggccgtccagacgggcatcgagcttctctcgggcaccgaacatctgcgcctgctcgaacaggctgtgactgtcccgtccgctgctaccgacgcgatcggcgaagccgcgcgaaaggccggcatggtcgtgtccattggcgtcaatgagcgcgatggcggcacgctgtacaacgcacaactgctcttcgatgccgacggtacgctgatccagcgccgccgcaagatcacgccgacgcatttcgaacgcatgatctggggccagggagatggctcgggcttgcgtgcagtcgacagcgccgtcggccgcgtcggccagctcgcatgtttcgagcacaacaacccgctcgcccgctacgcaatgatcgccgacggcgagcagatccattcggcgatgtaccctggctcggcctttggcgagggcttcgcccagcgtatggaaatcaacatccgccagcatgcgctcgagtccgccgctttcgtcgtcaacgcaacagcgtggctggacgccgaccagcaggcgcaaatcatgaaggacaccggttgtggaatcggtccgatcacgggcggctgcttcaccacgatcgtctctcctgacggcatgctgatggccgagccgcttcgctcgggtgaaggcgaagtgatcgtcgatctcgacttcacgcagatcgaccgccgcaagatgctgatggactcggccggccactacaaccgccctgaactgctgagtctgatgatcgaccgtacgccgaccgcgcatgttcacgaacgcgcttcgcacccgatgatcgtcaacgaccagggttccgacgatctgcgcacccaggctgcatga

SEQ ID NO: 196 - protein, 330 aa, Unknown
  Obtained from an environmental sample
MKVVKAAAVQFSPVLYSREATVAKVVQKIHELGQKGVQFATFPETVVPYYPYFAAVQTGIELLSGTEHLRLLEQAVTVPSAATDAIGEAARKAGMVVSIGVNERDGGTLYNAQLLFDADGTLIQRRRKITPTHFERMIWGQGDGSGLRAVDSAVGRVGQLACFEHNNPLARYAMIADGEQIHSAMYPGSAFGEGFAQRMEINIRQHALESAAFVVNATAWLDADQQAQIMKDTGCGIGPITGGCFTTIVSPDGMLMAEPLRSGEGEVIVDLDFTQIDRRKMLMDSAGHYNRPELLSLMIDRTPTAHVHERASHPMIVNDQGSDDLRTQAA

SEQ ID NO: 197 - DNA, 1017 bp, Unknown
  Obtained from an environmental sample
atgggcatcgaacatccaaaataccgcgttgccgccgtgcaggctgcgccggcctggctcgacctcgatcgctcgatcgacaaggctattgcactgatcgaggaggccgccgcgaacggcgccagattgatcgcattcccggaggtcttcatccccggctacccctggcatatctggctcgactcgccggcctgggcgatcggccgcggcttcgtgcagcgttatttcgacaattcgctcgcttatgatagtccgcaggccgagcggctccgcgcagcggtccgcaaggcgcgcctgaccgccgtgatcggcctttcggagcggagcggcggcagcctctacatcgcgcaatggctcgttggccccgacggcgagaccatcgcgaagcgccgcaagctccgtccgacgcatgccgagcgcacggtctatggcgagggcgacggcagcgatctggcggtccatgaccggcccgatatcggacggctcggcgcgctgtgctgctgggaacatctgcaaccgttgtcgaaatatgcgatgtatgcccagaacgagcaggtccatgtggcgtcatggccgagtttttcgctctacgatccctttgccccggcgctcggcgcggaggtgaacaatgcggcctcccgggtctatgcggtcgaaggctcctgcttcgtgctggcgccgtgcgcgaccgtctcgcaggccatgatcgatgagctgtgcgaccggcccgacaagcacgcgctgctccatgccggcggtggctttgccgcgatctacgggcccgacggcagttcgctggccgaaaagctcgcgccggaccaggagggcctgctttacgccgacatcgatctcggcgcgatcggcgtcgcgaagaacgccgccgacccggcagggcattattcgcggcccgatgtcacgcggctgctgctgaacaacaagccctacaagcgcgtggagcattttgctttgcccggcgataccgtggcgcctgccgatgtggatgcggcggcgagctga

SEQ ID NO: 198 - protein, 338 aa, Unknown
  Obtained from an environmental sample
MGIEHPKYRVAAVQAAPAWLDLDRSIDKAIALIEEAAANGARLIAFPEVFIPGYPWHIWLDSPAWAIGRGFVQRYFDNSLAYDSPQAERLRAAVRKARLTAVIGLSERSGGSLYIAQWLVGPDGETIAKRRKLRPTHAERTVYGEGDGSDLAVHDRPDIGRLGALCCWEHLQPLSKYAMYAQNEQVHVASWPSFSLYDPFAPALGAEVNNAASRVYAVEGSCFVLAPCATVSQAMIDELCDRPDKHALLHAGGGFAAIYGPDGSSLAEKLAPDQEGLLYADIDLGAIGVAKNAADPAGHYSRPDVTRLLLNNKPYKRVEHFALPGDTVAPADVDAAAS

SEQ ID NO: 199 - DNA, 993 bp, Unknown
  Obtained from an environmental sample
atgtcaaacgcactgaagccgttcaaaatcgccgccgttcaggcgacgccggtttttctgaaccgggaagccacggcggagaaggccgcggctttgatccgcgaagcgggaagcgccggagccaagctcatcgttttcccggaatcgtttattccggcctatccggactgggtctgggtggtcccctcggggagggatcgccttctcagcggcctctacggggagatgctcgaaaacgccgtggaaatccccggcccggccacggggcatatcggccgggcggcgaaggaatcgggcgcttatgtcgtcatgggcgtgaccgagcgggacacggaggcgagcggagccagtttgttcaacaccttgatttatttcggtccgaccggggaaattttgggcaaacaccggaagctggttcccaccgggggcgaacggatcgtctgggcccagggggacggaagcaccctggaggtctacgatacgcccctgggaaaactgggcgggctgatctgctgggaaaactacatgcccctggcccggtacgccatgtacgcctggggaacccagctttacgtggccgccacctgggaccgaggcgaaccctggctttcgacgcttcggcatatcgccaaggaagggcgggtgtatgtcatcgggtgctgcatcgccatgcggaaaggggatatcccggatcggttcgaacacaaggggctctacgcccccgaccgggactggatcaaccccggcgacagcgcgatcgtcaacccccagggggagatgatcgccgggcccgcttccaataaggaagagatcctttatgcggaagtcgacccgcagatgatgcgcgggcccaaatggatgctcgatgtggccggccattacgcgcggcccgatgtcttcgagctcaccgtccgccgggaaccgcggccgatgatccgcgtggcgggaggcgcgggcgggaccgaacccaaagagaagaagaccgccggctga

SEQ ID NO: 200 - protein, 330 aa, Unknown
  Obtained from an environmental sample
MSNALKPFKIAAVQATPVFLNREATAEKAAALIREAGSAGAKLIVFPESFIPAYPDWVWVVPSGRDRLLSGLYGEMLENAVEIPGPATGHIGRAAKESGAYVVMGVTERDTEASGASLFNTLIYFGPTGEILGKHRKLVPTGGERIVWAQGDGSTLEVYDTPLGKLGGLICWENYMPLARYAMYAWGTQLYVAATWDRGEPWLSTLRHIAKEGRVYVIGCCIAMRKGDIPDRFEHKGLYAPDRDWINPGDSAIVNPQGEMIAGPASNKEEILYAEVDPQMMRGPKWMLDVAGHYARPDVFELTVRREPRPMIRVAGGAGGTEPKEKKTAG

SEQ ID NO: 201 - DNA, 930 bp, Unknown
  Obtained from an environmental sample
atgaccacgaagagcatccgcatcgcggccgtacaggcggctcccgcgtttctcgacctggctggtacgctggaccggctcgaggcctgggcccgcaaggccgccgccaccggtgcccgcgtcatcgcgttccccgagacctggctgccgggctacccggcgtggatcgactcgtcgccggaggccgcgatctggggccatcccggctcgcgcgacctgcaccagcgcctgatggagaatgccgtcgaggtcccgggccccgcgaccgcgcgcatcgcgaagctcgccggcgagctcggcgtgacgatcgtggtcggcgcgcacgagcgggcggggaacaccctctacaacacggcgctgacgttcgggcccgagggcaggctgctcaatcaccaccggaagctggtgccgacctacagcgaacggctgctgtggggctacggcgacggcgctggactggtggcgccggcggtggacggtgtgaaggtcggggcgctggtgtgctgggagcactggatgccgctcacccgccaggcgatgcacgacgtcggcgagcacgtgcacgtcgccctgtggcccggcgtccacgagatgcaccaggtggcctcgcggcactatgcgttcgagggccgctgtttcgtgatcgcggtcgggagcatcctgcgcgtggaccagatgccgaagcagctgccgccgctggagaagtacgcgaagagcgccaaggggctgatgatcgcgggcggcagcgccatcatcgcgccgaacggccgctacgtcgcggcgccggtgtacgacgaggagacgatcgtcaccgccgactgcgacctcggcgagatcccgcgcgaggcgcagacgctcgatgtctcgggccactacagccggccggacgtgttcagcttcggggtggtcagacaccggccgcgtgcgtaa

SEQ ID NO: 202 - protein, 309 aa, Unknown
  Obtained from an environmental sample
MTTKSIRIAAVQAAPAFLDLAGTLDRLEAWARKAAATGARVIAFPETWLPGYPAWIDSSPEAAIWGHPGSRDLHQRLMENAVEVPGPATARIAKLAGELGVTIVVGAHERAGNTLYNTALTFGPEGRLLNHHRKLVPTYSERLLWGYGDGAGLVAPAVDGVKVGALVCWEHWMPLTRQAMHDVGEHVHVALWPGVHEMHQVASRHYAFEGRCFVIAVGSILRVDQMPKQLPPLEKYAKSAKGLMIAGGSAIIAPNGRYVAAPVYDEETIVTADCDLGEIPREAQTLDVSGHYSRPDVFSFGVVRHRPRA

SEQ ID NO: 203 - DNA, 966 bp, Unknown
  Obtained from an environmental sample
atgtcaagcttacccacatccgcgttcaccgtcgccgccgcgcaagcgtcgccagtgttcctcgaccgcgacgcgacgctgcagaaggcttgcgggctgatcgccgacgccgggcgcgcgggcgcgcgcctgatcgtcttccccgaagccttcatcccggcctaccccgattgggtgtgggcggtcccagctggcgaagaggggatgctgagcgagctctacgccgagctggtcgcgaattcgctggctattccgagcgacgcgaccgatcggctatgtcgcgcggcgcaggccgcgcatatcaatgtggtcgtggggttgagcgagcgcaatgtcgaggccagcggcgccagcctctacaacacgctgctgtatatcgacgcggcgggaacgatcctgggtaaacaccgcaagcttgtgccgaccggcggggagcgcctggtctgggcgcagggcgacggcagcacgctcgatgtgtacgacaccgcgctcggcaagctcggcggcctgatctgttgggaaaactacatgccgctggcacgctacgcgctgtacgcctggggtgtgcaaatctatgtcgcggccacctgggatcgcggcgagccctggctttctactctgcgacatatcgccaaggaaggccgtgtctacgtgatcggctgtggcatggcgctgcgcagagatgatattcccgatcgcttcgctttcaagcagcgcttctatgcccaggccggcgaatggatcaacgtcggcgacagcgcgatcgtcaacccgagcggcgagtttattgccggacctgtgcgcgaacgcgaggagattctgtacgcggaggtcgacccggagcagatgagcgggccaaagtggatgctcgacgtggccgggcactacgggcggccggatgtcttccggctcagcgtcaaccgggcgccgcaccagatgatccagacggagaaccgggagacctga

SEQ ID NO: 204 - protein, 321 aa, Unknown
  Obtained from an environmental sample
MSSLPTSAFTVAAAQASPVFLDRDATLQKACGLIADAGRAGARLIVFPEAFIPAYPDWVWAVPAGEEGMLSELYAELVANSLAIPSDATDRLCRAAQAAHINVVVGLSERNVEASGASLYNTLLYIDAAGTILGKHRKLVPTGGERLVWAQGDGSTLDVYDTALGKLGGLICWENYMPLARYALYAWGVQIYVAATWDRGEPWLSTLRHIAKEGRVYVIGCGMALRRDDIPDRFAFKQRFYAQAGEWINVGDSAIVNPSGEFIAGPVREREEILYAEVDPEQMSGPKWMLDVAGHYGRPDVFRLSVNRAPHQMIQTENRET

SEQ ID NO: 205 - DNA, 969 bp, Unknown
  Obtained from an environmental sample
atgaccaccgtaaaagccgccgcagtacagatcagccccgtgctctatagccgggaggccaccgtagacaaggtcgttcgcaagatccgcgagctcggccaaaagggagtgcagttcgccaccttcccggaaaccgtagtgccgtactacccctacttcgctgcagtccagacaggcatcgaactgttgtccggcaaggaacacatgcgcctgctggagcaggccgttaccgtcccctcgcccgccacggatgcgattgctcaggcggcgcgcgaagccaatatggtggtgtccatcggcgtcaacgagcgcgacggcggcaccatctacaacacgcagctgctcttcgatgccgacggcacgctcgtgcagcgccgccgcaagataacgccaacgcacttcgagcgcatggtctggggccagggcgatggttcgggattgcgcgccgcggacaccaaggttggccgcatcggccagttggcctgcttcgagcacaacaacccgctcgcccgttacgccatgatggccgatggcgagcagatccactccgccatgtacccgggctcggccttcggcgagggcttcgcgcagcgcatggagatcaacatccgccagcatgccctggagtctggctgcttcgtggtgaatgcgaccgcctggctcgatgccgaccaacaggcgcagatcatgaaggacaccggttgctcgatcggcccgatctccggcggctgcttcacgaccatcgtcacgcctgagggcatgctgattggcgagccgctccgcgagggcgaaggcgaaatcatcgccgacctcgatttctcgatgatcgatcgccgcaagctgctgatggactcggtcggtcactacaaccgtccggagcttctgagcctcctgatcgatcgcacgcctgccgcgaacttccatgaacgtaccgcgagccaggcgaacgccggcgtcgaaatcctctga

SEQ ID NO: 206 - protein, 322 aa, Unknown
  Obtained from an environmental sample
MTTVKAAAVQISPVLYSREATVDKVVRKIRELGQKGVQFATFPETVVPYYPYFAAVQTGIELLSGKEHMRLLEQAVTVPSPATDAIAQAAREANMVVSIGVNERDGGTIYNTQLLFDADGTLVQRRRKITPTHFERMVWGQGDGSGLRAADTKVGRIGQLACFEHNNPLARYAMMADGEQIHSAMYPGSAFGEGFAQRMEINIRQHALESGCFVVNATAWLDADQQAQIMKDTGCSIGPISGGCFTTIVTPEGMLIGEPLREGEGEIIADLDFSMIDRRKLLMDSVGHYNRPELLSLLIDRTPAANFHERTASQANAGVEIL

SEQ ID NO: 207 - DNA, 966 bp, Unknown
  Obtained from an environmental sample
atgtcaaacgagaacaacaacgctacattcaaagttgccgcagtacaggctacacctgtttttctcgatcgtgaagcgactctcgacaaggcttgcgatttgatcgccgccgccggaggtgaaggggcacgattggttgtctttccagaagccttcataccggcctatccggattgggtatgggcaatcccaccgggtgaagagggcgtacttaatgagttgtacgcagagctgctctccaactcggtcacgattcccagtgacgcgacggacagactgtgccgggccgcgaggcttgctaatgcttacgtggtgatggggataagcgaacgcaatgtcgaggcgagtggagcaagcctgtataacacgctgttgtacatcgatgcgcagggtgagattctaggcaaacatcgaaagctagtgccaacgggcggcgagcggctggtgtgggcgcagggcgatggcagcacactgcaggtctacgatactccactgggaaaactcggcggtttaatttgctgggagaattatatgccgctggcccgctataccatgtatgcctggggcacacaaatctatgtcgccgctacgtgggatcgcgggcaaccctggctctccactttgcggcatatcgccaaagaaggcagggtgtacgtgattggttgttgtatcgcgatgcgcaaagacgatatccctgatcgttacgcaatgaagcagaagttttacgcggaggcagatgagtggatcaatataggtgacagcgcgattgtcaatcctgaagggcaatttatcgcagggccagtacgcaagcaggaagagattctctacgcagagattgatccgcgcatggtacaagggccgaagtggatgctcgacgtggcggggcactatgccaggccggatgtgttccagttgacggtgcatacggatgtgcgacagatgattcggatggaacacgattcttaa

SEQ ID NO: 208 - protein, 321 aa, Unknown
  Obtained from an environmental sample
MSNENNNATFKVAAVQATPVFLDREATLDKACDLIAAAGGEGARLVVFPEAFIPAYPDWVWAIPPGEEGVLNELYAELLSNSVTIPSDATDRLCRAARLANAYVVMGISERNVEASGASLYNTLLYIDAQGEILGKHRKLVPTGGERLVWAQGDGSTLQVYDTPLGKLGGLICWENYMPLARYTMYAWGTQIYVAATWDRGQPWLSTLRHIAKEGRVYVIGCCIAMRKDDIPDRYAMKQKFYAEADEWINIGDSAIVNPEGQFIAGPVRKQEEILYAEIDPRMVQGPKWMLDVAGHYARPDVFQLTVHTDVRQMIRMEHDS

SEQ ID NO: 209 - DNA, 993 bp, Unknown
  Obtained from an environmental sample
atgaaagtcgtcaaagccgccgctgtccagatcagtcccgttctctacagccgtgaggcaaccgtcgaaaaggtcgtgaagaaaattcacgagcttggccaactgggcgtgcagttcgccacctttcccgagaccgtagtgccttactacccgtacttttccgccgtccagacaggcattgagcttctgtccggaactgagcatctgcggctgctcgatcaggccgtgacggtaccgtctcccgctaccgatgcgatcggagaggcggcccgcaaggcgggcatggtggtgtccatcggcgtgaatgaacgcgacggcggcaccttgtacaacacacagttgctcttcgatgccgatggcaccttgatccagcgccgccgcaagatcacgcccacccacttcgaacggatgatctggggccagggggacggctcgggcctgcgcgccgtcgacagcaaggttggtcgcattggtcagcttgcctgcttcgagcacaacaacccgctggcccgctacgcgctgattgccgacggcgagcagatccattccgccatgtatccgggttctgctttcggcgaaggctttgcccaaaggatggaaatcaatatccgccagcatgcgctggagtctggtgcctttgtcgtcaacgcaacggcctggctggatgctgaccagcaggcgcaaatcatcaaggacaccggctgtgggattggcccgatctcgggcggctgcttcaccacgatcgtggcacccgacggcatgctgatggccgaacctctgcgttcgggcgagggtgaggtcatcgtggatctcgacttcacgctgatcgaccgacgcaagatgttgatggactcggcgggccactataaccgtccagaactgctcagtctcatgattgaccgtaccgcgacggcgcatgttcacgaacgcgctgcgcatccggtgtcgggcgcggagcagggtccggaggatctgcgcactccggccgcgtga

SEQ ID NO: 210 - protein, 330 aa, Unknown
  Obtained from an environmental sample
MKVVKAAAVQISPVLYSREATVEKVVKKIHELGQLGVQFATFPETVVPYYPYFSAVQTGIELLSGTEHLRLLDQAVTVPSPATDAIGEAARKAGMVVSIGVNERDGGTLYNTQLLFDADGTLIQRRRKITPTHFERMIWGQGDGSGLRAVDSKVGRIGQLACFEHNNPLARYALIADGEQIHSAMYPGSAFGEGFAQRMEINIRQHALESGAFVVNATAWLDADQQAQIIKDTGCGIGPISGGCFTTIVAPDGMLMAEPLRSGEGEVIVDLDFTLIDRRKMLMDSAGHYNRPELLSLMIDRTATAHVHERAAHPVSGAEQGPEDLRTPAA

SEQ ID NO: 211 - DNA, 1062 bp, Unknown
  Obtained from an environmental sample
atgggcgtcgcacatccgaaatacaaagtggccgccgtgcaggcagcgcccgcttttctcgacctggacgcctcggtcgaaaaggccgtccgtttcatcgacgaagccggcgccgccggcgcccgcctcatcgcctttccggagacctggatacccggttacccctggtggatctggctaggcgcgccggcctgggctatcatgcgcggcttcgtctcgcgctatttcgacaactcgctcagctacgacagcccgcaggccgagaagctccgcgccgccgccaagcgcaacaagatggtggtggtgctcggcctctccgagcgcgacggcggcagcctttacatcgcgcaatggatcatcggcccggacggcgaaaccatcgccaagcgccgcaagctcaagccgacccacgcggagcggaccgtgttcggcgaaggcgacggctcgcatcttgcggtgcacgagcttgatgttggccggctcggcgcgctgtgctgctgggaacacctgcagccgctgtccaaatacgccatgtatgcgcagaacgaacaggtgcatgtcgcggcctggccgagcttttcgctttacgatccgttcgcgcacgcgctcggcgcggaagtgaacaatgcggcgagcaaaatctatgcggtcgagggctcgtgtttcgtcatcgcgccgtgcgcgaccgtttcgcaggcgatgatcgacgaactctgcgatacgccggagaagcatcagttcctgcatgccggcggcggctttgccgtgatttacggccccgacggcgccccgctcgcggcgccgctgccgcccgacaaggaaggcttgctctacgccgacatcgatctcgggatgatttcggttgccaaagcggcagccgatccggccgggcattatgcacgccccgacgtcacccggcttctgttcaacaatcggcctgggtatcgggtcgagaccatggcgttgccgatcgatgcggagaccaaggcggaagcaccggctaagccggaacccaaggcaccgaacgtggcgccgttcgcgccggtgcaagcggccgagtga

SEQ ID NO: 212 - protein, 353 aa, Unknown
  Obtained from an environmental sample
MGVAHPKYKVAAVQAAPAFLDLDASVEKAVRFIDEAGAAGARLIAFPETWIPGYPWWIWLGAPAWAIMRGFVSRYFDNSLSYDSPQAEKLRAAAKRNKMVVVLGLSERDGGSLYIAQWIIGPDGETIAKRRKLKPTHAERTVFGEGDGSHLAVHELDVGRLGALCCWEHLQPLSKYAMYAQNEQVHVAAWPSFSLYDPFAHALGAEVNNAASKIYAVEGSCFVIAPCATVSQAMIDELCDTPEKHQFLHAGGGFAVIYGPDGAPLAAPLPPDKEGLLYADIDLGMISVAKAAADPAGHYARPDVTRLLFNNRPGYRVETMALPIDAETKAEAPAKPEPKAPNVAPFAPVQAAE

SEQ ID NO: 213 - DNA, 993 bp, Unknown
  Obtained from an environmental sample
atgagagttgttaaagccgctgctgtccaactgagtcccgtcctctatagtcgcgagggaacggtcgaaaaggtcgtgcggaagatccatgaacttgccgaagagggagtcgagttcgccacctttcctgagaccgtggtgccttactacccgtacttttccttcgttcagacgcccttggagcaaatcttcggaacagagtatctgaggctgctcgaccaggcagtcaccgtgccatcccctgccaccgacgcgatcggcgaggcagccaggttcgctggagttgttgtctcgatcggcgtcaacgagcgagacgggggaactctatacaacactcagcttctcttcgatgccgacggcaggataattcagcggcgccgcaagatcacgcccacccattacgagcgcatgatctggggccagggcgacggctcaggtctgcgggccgttgatagcaaggccggccgtattggtcagctggcatgctgggagcacaacaatccactggcgcgctacgcgctgatggccgacggcgagcagatccattccgccatgtatccgggctccatgttcggcgactcgtttgcccagaagaccgaaatcaatatccggcagcatgccctagagtctgggtgcttcgtcgtgaacgcaacggcctggctggacggcgatcagcaggcgcatatcatgaaggacaccggctgcagcatcggcccgatctccggcggttgcttcactgcgatcgtcgcacccgatggtagcctgctgggcgaacccatccgttccggtgagggcgtggtcatcgccgacctcgacttcacgttgatcgacaggcgtaagcaggtgatggactcgcgaggccattacagccggccggagttgctcagcctcttaatagaccgcacccctaccgcgcactttcacgaacgcgcttcgccccccacgacagaagctgagcaaggctccgaggatgtgttcgaggctcgcatttaa

SEQ ID NO: 214 - protein, 330 aa, Unknown
  Obtained from an environmental sample
MRVVKAAAVQLSPVLYSREGTVEKVVRKIHELAEEGVEFATFPETVVPYYPYFSFVQTPLEQIFGTEYLRLLDQAVTVPSPATDAIGEAARFAGVVVSIGVNERDGGTLYNTQLLFDADGRIIQRRRKITPTHYERMIWGQGDGSGLRAVDSKAGRIGQLACWEHNNPLARYALMADGEQIHSAMYPGSMFGDSFAQKTEINIRQHALESGCFVVNATAWLDGDQQAHIMKDTGCSIGPISGGCFTAIVAPDGSLLGEPIRSGEGVVIADLDFTLIDRRKQVMDSRGHYSRPELLSLLIDRTPTAHFHERASPPTTEAEQGSEDVFEARI

SEQ ID NO: 215 - DNA, 1008 bp, Unknown
  Obtained from an environmental sample
atgagtattacccaccccaaatttaaagctgctgttgttcaagctgccccagtatttctagacctagatgggtctgttaataaggcgattaatctcattgatgaagctgccgctgccggagccaagctcattgccttccctgaaaccttcattccaggctatccatggtggatttggctgggatcgccggcgtgggctctgggccgggggttcgttcagcgttacttcgacaattccctgcagtacgacagcccgcaggcggatcgcttacgcgaggcggcacgacgcaacagcattacggtcgtgctgggcttgtccgagcgtgatggcggttctctctatatcgcacagtggctgatcggcccggatggcgaaaccatcgcgcagcggcgcaagcttcgtcctactcatggggagcgcacggtattcggtgaaggggatggcagcgatctggtggttcatcaaaccgaactgggccgtcttggcgcgcttaactgctgggagaacatcctgtctctgaacaaatatgtgatgtactcccagcatgaacaggtccatgtagcatcctggcccagtttctcgacgtatgaaccgttcgcgcatgcgctcggctatgaggtaaacaacgcaattagccaggtctatgcggtggaaggcgggtgcttcgtgttggccccgtgctctaccatctctgaagaaatgattgccgaactgtgcgatacacccgataaattcgagctgacgcatgctggtggcggccacgcaatcatctatggtccggacggtcgtgctctgtgcgaaaagctgcccgagaaccaggagggcctgctgtacgcggaaatcgatctgggggtgatttctatggcaaaaagtgccatggatcctgtcggccattactctcgccccgatgtctaccgtgtgctgttcaataagatcccggcaaagcgtatcgagcacttcaatttgccgttggatgagcaagcaggggaagagccaccagctgattaa

SEQ ID NO: 216 - protein, 335 aa, Unknown
  Obtained from an environmental sample
MSITHPKFKAAVVQAAPVFLDLDGSVNKAINLIDEAAAAGAKLIAFPETFIPGYPWWIWLGSPAWALGRGFVQRYFDNSLQYDSPQADRLREAARRNSITVVLGLSERDGGSLYIAQWLIGPDGETIAQRRKLRPTHGERTVFGEGDGSDLVVHQTELGRLGALNCWENILSLNKYVMYSQHEQVHVASWPSFSTYEPFAHALGYEVNNAISQVYAVEGGCFVLAPCSTISEEMIAELCDTPDKFELTHAGGGHAIIYGPDGRALCEKLPENQEGLLYAEIDLGVISMAKSAMDPVGHYSRPDVYRVLFNKIPAKRIEHFNLPLDEQAGEEPPAD

SEQ ID NO: 217 - DNA, 1011 bp, Unknown
  Obtained from an environmental sample
gtgggtatcagccatccgaaattcaaggctgcggtcgtacaggccgggcctgccttcctcgacctcgacggcggcgtcgaacgagccgtgtcgctcatcggccaagcagcggccgaaggggcacagctgattgcctttcctgaaacgtggattcccggttacccgtggcacacctggcttggcagcccggcgtgggcaatggaaaaaggctttgtccaacgatatttcgacaacgcgttgcggcatggttctccgcaagccgagcgaatctccggggctgcggcggagcacaagattatggtgtcgcttgggtttgcggaacgcgatggaggcacgctttatatcgcgcagtggctcatcggacccgacggccaaactatctcacgacggcggaagcttaagccgactcacgtcgagcgcactgtatttggcgagggagacggaagcgatctctccgtgcatgatacggcgcttggacgtatcggctcactttgttgctgggagcatttgcaaccgttgtcgaaatacgcaatgtacgcccagaatgaacagattcacattggcgcatggcccagcttttcgctataccagccatttgcgaatgcgctgagtcccgaagtcaatatcgcagtaagccgcgtgtacgccgtggaaggccagtgtttcttcctcgcgccgtgcgcgacggtttcggacgccatgatcgaaacactgtgcgatacgcccgaaaagcagggactgattcgggcgggtggcgggcacgccgcgatcttcggcccagatggaagtctgctgacgcctacggtagcggatacttacgagggcctgctgtatgcagaactcgacctcggcgtcatttcgatcgccaagagtgcagcggaccccgccggccactattcgcggccagatgtcacacgccttctattgaatcagacgccttcgaagcgcgttcagaatatggtgttaccactggagacggtcacggagcccgaaggcccggttcagccctag

SEQ ID NO: 218 - protein, 336 aa, Unknown
  Obtained from an environmental sample
VGISHPKFKAAVVQAGPAFLDLDGGVERAVSLIGQAAAEGAQLIAFPETWIPGYPWHTWLGSPAWAMEKGFVQRYFDNALRHGSPQAERISGAAAEHKIMVSLGFAERDGGTLYIAQWLIGPDGQTISRRRKLKPTHVERTVFGEGDGSDLSVHDTALGRIGSLCCWEHLQPLSKYAMYAQNEQIHIGAWPSFSLYQPFANALSPEVNIAVSRVYAVEGQCFFLAPCATVSDAMIETLCDTPEKQGLIRAGGGHAAIFGPDGSLLTPTVADTYEGLLYAELDLGVISIAKSAADPAGHYSRPDVTRLLLNQTPSKRVQNMVLPLETVTEPEGPVQP

SEQ ID NO: 219 - DNA, 996 bp, Unknown
  Obtained from an environmental sample
atgaaaatcgtcaaagctgccgccgttcaaattagtcccgtgctttatagccgcgatggaacggtggaaaaagttgtgcggaagatccatgagctcggccaacagggagtgcagttcgcaaccttccccgagaccgtgattccgtactatccctatttttcctttctgcaacccgcctaccagatcgcggccgggcaggagcacctcaagttgctcgaccaggcggtgacggtgccgtccgctgccacgcacgcgatcggccaggcatgcaaacaggcaggagtggttgtttcgatcggcatcaatgagcgggacaatggaacgatctacaacacccagcttctcttcgactccgacggaaccctgctgcagcggcgccgcaagatctcacccacttaccacgaacggatgatctggggccagggcgacggttccggcctgcgcgccgtggatagcaaggccggccggattgggcagctcgcctgttgggagcactacaaccctttggcgcgctacgcgatgatggccgacggcgagcagatccattccgccatgtaccctggctccatcttcggcgatctgtttgccgaacagacccagatcaacgtccggcagcacgcgttggagtccggctgtttcgtagtctgctccaccgcctggttggatcccgatcaacaagcgcaaatcgtcaaggacacaggcggcgccattggtgcgatctcgggcggctgtttcacggcgattgtggcccccgatagcactctgctcggagagccgatccgctccggcgaaggcgtggtcattgcggatctcgacttcacccggatcgacaagcgtaaacagttgatggattcccgaggtcattacagccggccggaattgctgagtctgctgattgatcgcacttccaccgcacatgtgcaaaaccgcgtgccggccgatccattcggcgccggctgtgttgcagaaccaggagtagaaacatgcccacgatag

SEQ ID NO: 220 - protein, 331 aa, Unknown
  Obtained from an environmental sample
MKIVKAAAVQISPVLYSRDGTVEKVVRKIHELGQQGVQFATFPETVIPYYPYFSFLQPAYQIAAGQEHLKLLDQAVTVPSAATHAIGQACKQAGVVVSIGINERDNGTIYNTQLLFDSDGTLLQRRRKISPTYHERMIWGQGDGSGLRAVDSKAGRIGQLACWEHYNPLARYAMMADGEQIHSAMYPGSIFGDLFAEQTQINVRQHALESGCFVVCSTAWLDPDQQAQIVKDTGGAIGAISGGCFTAIVAPDSTLLGEPIRSGEGVVIADLDFTRIDKRKQLMDSRGHYSRPELLSLLIDRTSTAHVQNRVPADPFGAGCVAEPGVETCPR

SEQ ID NO: 221 - DNA, 1146 bp, Unknown
  Obtained from an environmental sample
atgttgacctacaaaggcgtgttcaaagcagcgacagttcaggcggagccggtgtggatggacgctgacgccaccattaccaaagccatccggatcatcgaagaggcggctgataacggggcgaagtttgtcgcattcccggaggtgttcatccctggatacccttggtggatctggctgggcactgcgatgtggggagccaaattcgtcgtgcccttccacgaaaattgccttgagcttggcgacaagcggatgcagcgcattcaagctgcggcaaaacaaaatggcattgcactcgtcatgggttacggtgaacgtgacggaggtagccgctacatgagccaggtattcatcgacgatagcggaaaaattgtggcgaaccgccgcaagctcaaaccgacgcacgaagagcgaacgattttcggcgagggaaacggatccgatttcatcacccatgacttcccatttgcgagagtcggaggcttcaactgctgggaacaccttcagcccctgagcaaatacatgatgtacagcctgcaggaacaggtgcatgtcgcgtcgtggccggccatgtgcacctatcagcctgacgtgccccagttaggtgcaggcgctaacgaggcggtcacccgctcttacgcgatcgaaggcgcatgttatgtgctgggagcgacactcgttatcggcaaggcagcccatgatgcattctgcgacactgaagagcatcacaagctgcttggcatgggcggagggtgggcccgaattttcggcccggacggtgagtatctcgcagaatcgctcgctcatgacgcggagggcatcctgtacgctgacattgatctgagcaagatcctgctcgccaaagcaaacacggacacagttggccactacgcgcgacctgacgtcttgtcattgctcgtcaacacacacaatcccgggcctgtacgctatcttgacgaagagggccggcaggtttcaacgtcaattcgcaggcacgaaaaactggaaggccagagcctcgacctcgaggttacgccagcgacaccagcgaccctggacatcgcgagcctggtacaacaggctaagccatcgaccgttaagagcgagagtaacgcgagcacaaaacaaccggatctcgcggtctga

SEQ ID NO: 222 - protein, 381 aa, Unknown
  Obtained from an environmental sample
MLTYKGVFKAATVQAEPVWMDADATITKAIRIIEEAADNGAKFVAFPEVFIPGYPWWIWLGTAMWGAKFVVPFHENCLELGDKRMQRIQAAAKQNGIALVMGYGERDGGSRYMSQVFIDDSGKIVANRRKLKPTHEERTIFGEGNGSDFITHDFPFARVGGFNCWEHLQPLSKYMMYSLQEQVHVASWPAMCTYQPDVPQLGAGANEAVTRSYAIEGACYVLGATLVIGKAAHDAFCDTEEHHKLLGMGGGWARIFGPDGEYLAESLAHDAEGILYADIDLSKILLAKANTDTVGHYARPDVLSLLVNTHNPGPVRYLDEEGRQVSTSIRRHEKLEGQSLDLEVTPATPATLDIASLVQQAKPSTVKSESNASTKQPDLAV

SEQ ID NO: 223 - DNA, 996 bp, Unknown
  Obtained from an environmental sample
atgagagttgttaaagccagcgcagttcaactgaagcctgtactttatagccgcgaggggacggtcgaaaaggtcgtagcgaagattcatgagctagggcagcagggtgtgcagttcgccgcgttccctgagaccgtggtgccttattacccgtacttttcgatcgtgcagtccggctatcaaatccttcgcggcggtgagttcgtcaagctcctcgatcagtccgtgacggtgccatcttatagcactgaagccatcggcgaagcctgcaggcaggaggagatggttgtctccataggcgtcaacgagcgtgatggcggaacgatctacaacgcgcagttactctttgattccgacggcacgttgatccaaagacgacgcaagatcacccccacccattacgaacgcatgatctggggccagggcgatggctcaggtctgcgcgctgttgacagcaatgtcgcacgcattggtcaactggcatgctttgagcactacaaccctcttgcgcggtacgcgatgatggccgatggcgagcagatccattccgccatgttccccggttccatgttcggcgatggttttgcggagaggacggaaattgccgtaaggcaacatgcgatggagtccgggtgctttgtcgtttgcgctacggcctggctcgatcccggccagcaggctcagatcgccaacgacaccggtatcaccgacatcggcccgatctccgggggttgcttcactgcgatcatcgcacccgatgggagcctgctgggccaacctatccgctcgggtgaaggcgaagtcatcgtcgacctcgatttcacgttaattgacaagcggaaacatattgtcgactcgagaggacattacagccggccagaattgctgagcctgctgatcgatcgcactcccaccgcgcaccttcacgaccgcgctgtgcagcacaatgccggatcggaaggagcgtcggaacatcttcgcgaagacgccgcctga

SEQ ID NO: 224 - protein, 331 aa, Unknown
  Obtained from an environmental sample
MRVVKASAVQLKPVLYSREGTVEKVVAKIHELGQQGVQFAAFPETVVPYYPYFSIVQSGYQILRGGEFVKLLDQSVTVPSYSTEAIGEACRQEEMVVSIGVNERDGGTIYNAQLLFDSDGTLIQRRRKITPTHYERMIWGQGDGSGLRAVDSNVARIGQLACFEHYNPLARYAMMADGEQIHSAMFPGSMFGDGFAERTEIAVRQHAMESGCFVVCATAWLDPGQQAQIANDTGITDIGPISGGCFTAIIAPDGSLLGQPIRSGEGEVIVDLDFTLIDKRKHIVDSRGHYSRPELLSLLIDRTPTAHLHDRAVQHNAGSEGASEHLREDAA

SEQ ID NO: 225 - DNA, 951 bp, Unknown
  Obtained from an environmental sample
atgaccaccgtcaaagccgccgctgtccagatgagtcccgtgctttacagtcgcgacgataccatcgagaaaatttgtcgacagatcatcgagcttggccgacagggagtgcagttcgccacgtttccagagacagttattccgtattatccatatttcgccttcgtgcagcggccttacgaaatgtcggcccaatatcatcagttgcttgatcaagcggtgaccgtgccttccggttcaacgcacgccattggggccgcctgtaaacaagccggaattgttgtctcaatcggcgtcaacgagcgggagggcggcacgctctatggcacacagttgctgtttgatgcagacggcctcttgatccagcgtcgccgcaagatcactccgacctaccacgagcggatgatttggggacagggtgacggttccgggctgcgagccgtagatagcgcggtcggtcgaatcggacagttggcgtgttgggaacaccacaatccgctggctcgttatgctttagcggccgatggcgaacaaattcacgcggcgatgtaccctggctcgatcttgggtgaactatttgccgagcagattcaggtcaacatccggcagcacgccatggaatctggttgcttcgtcgtgaacgccacggcctggctaagcgaggaacagcaagcccgaatcatgaaggacaccggatcattcgatagcccaatcaccggtggttgctttaccgccattgtcgcgcccaacgggcagataatcggtgaaccgctgcgcatcggcgaaggcgtcgtgattgccgatttggacttcgctttgattgatgagaggaagcggctgatggactcacgcggcctctatagccgccctgagttgctaagcttgttaatcgacagaatgcctacatcccatgtgcatgaacgggttgagcgtagcatggcgatggcatga

SEQ ID NO: 226 - protein, 316 aa, Unknown
  Obtained from an environmental sample
MTTVKAAAVQMSPVLYSRDDTIEKICRQIIELGRQGVQFATFPETVIPYYPYFAFVQRPYEMSAQYHQLLDQAVTVPSGSTHAIGAACKQAGIVVSIGVNEREGGTLYGTQLLFDADGLLIQRRRKITPTYHERMIWGQGDGSGLRAVDSAVGRIGQLACWEHHNPLARYALAADGEQIHAAMYPGSILGELFAEQIQVNIRQHAMESGCFVVNATAWLSEEQQARIMKDTGSFDSPITGGCFTAIVAPNGQIIGEPLRIGEGVVIADLDFALIDERKRLMDSRGLYSRPELLSLLIDRMPTSHVHERVERSMAMA

SEQ ID NO: 227 - DNA, 1035 bp, Unknown
  Obtained from an environmental sample
atgtccgatcgacgcatcgttcgcgcggcagccattcagatcgccccggatctcgagcgctgcagtgtaacgctcgagaaggtttgctcggcgatcgacgaagccgcgggcaaaggcgctcaactgagcgtctttcccgagaccttcgtcccgtactacccctatttctcgtttgtccgccctccggtcgcatcgggggccgatcacatgcggctatacgaggaagcggtggtggtgccgggtcccgtgacgcaggctgtttccgaacgtgcgcgcatgcatgggatggtggtggtgctcggcgtcaacgagcgcgaccacgggagcctctacaacacccaactgattttcgattgcgatggtcggctcgctctgaaacgccgcaagatcacgccgacgtttcacgagcgcatgatctggggccagggcgacgccagtggactgaaagtcgcgcgcacgggtatcgggcgggtcggcgcgctcgcgtgctgggagcattacaacccgctcgcgcgctacgcgctgatgacccagcacgaagagatccattgcagtcaatttccaggctcgctcgtcggtccgatcttctccgagcagatggacgtgacgatccgccatcacgccctcgaatcggggtgcttcgtcgtgaacgcaaccggttggctcacggacgcgcagatcgcctcgatcaccgatgacccgaagcttcaacgggcgctgcgcggtggctgcaacacggcgatcgtttcaccggaaggccagcatctggcggagccgttgcgcgaaggcgaggggatggtggtcgcggacctcgacatgtcgctcatcaccaagcgcaagcgaatgatggattcggtcggccactatgcgcggccggaactgttgagcctcgcgatcaacgatcgtcccgcagcccctttcggccggatgtgcgctgccgaagcaatgcggggagccgacgacgtcgtcacagtaggagcatttcatgagcgccagcgagaacgtgtcggcgaagagccggcaattgatgactga

SEQ ID NO: 228 - protein, 344 aa, Unknown
  Obtained from an environmental sample
MSDRRIVRAAAIQIAPDLERCSVTLEKVCSAIDEAAGKGAQLSVFPETFVPYYPYFSFVRPPVASGADHMRLYEEAVVVPGPVTQAVSERARMHGMVVVLGVNERDHGSLYNTQLIFDCDGRLALKRRKITPTFHERMIWGQGDASGLKVARTGIGRVGALACWEHYNPLARYALMTQHEEIHCSQFPGSLVGPIFSEQMDVTIRHHALESGCFVVNATGWLTDAQIASITDDPKLQRALRGGCNTAIVSPEGQHLAEPLREGEGMVVADLDMSLITKRKRMMDSVGHYARPELLSLAINDRPAAPFGRMCAAEAMRGADDVVTVGAFHERQRERVGEEPAIDD

SEQ ID NO: 229 - DNA, 975 bp, Unknown
  Obtained from an environmental sample
atgcctgaaaacaaagtcaaagttgccctcgttcagcatccgcctgtttttctgaatttgccgaaaacgttggaaaaagtagaaggtttggcgcgagagtgcgccgccaatgaagcgaaaatcgttgtctttcctgaaacctggctgaccggctatccggtctggcttgatgaagcgccgagagccgcgctgtgggattatccgcccgccaagcgtttgtatcaatacctcacggaaaattcattgcagattccgagcgctgagtttgaatctttgcgcgaaatcgctaagaaaaattccctttatttagtcgttggagttcacgaacgaagcggcggaacgctctacaatacgataatttatctcacgcccgacggcagttataaaactcaccgcaaattggttccaacttacacggaaagacttgtctggggcgcaggcgacggaagcggtctaaatgttgtggaaacgccttacgggattctcggaggtttgatttgctgggaacattggatgcctctggctagggcggcaatgcattcaaaaaatgaagcgattcacgtttgccaatttcccacggttcacgagcgacatcaaatcgccagccgtcattacgccttcgaagggcagtgttttgtcttgacttccggttgcgcgatgacgaaaacggatgttttggaaggttttgaatcgctcgaaacaaacgaccacgaagttttcgggcttttggattcgatagaaaaggaagaactgatgcgtggcggaagcgcgattattgcgcccgatttgagctattcggtcgagccggtttttgacgaaaaaacgattgtttacggcgaattaaatctcgatttaaccaagcagggacatctgtttttggataccgacggacattattcgcgtcccgatgttttcgagttgcgcgtcaacgataaagcgaaccgaaacgtccgttttgcatccgaaacagtatag

SEQ ID NO: 230 - protein, 324 aa, Unknown
  Obtained from an environmental sample
MPENKVKVALVQHPPVFLNLPKTLEKVEGLARECAANEAKIVVFPETWLTGYPVWLDEAPRAALWDYPPAKRLYQYLTENSLQIPSAEFESLREIAKKNSLYLVVGVHERSGGTLYNTIIYLTPDGSYKTHRKLVPTYTERLVWGAGDGSGLNVVETPYGILGGLICWEHWMPLARAAMHSKNEAIHVCQFPTVHERHQIASRHYAFEGQCFVLTSGCAMTKTDVLEGFESLETNDHEVFGLLDSIEKEELMRGGSAIIAPDLSYSVEPVFDEKTIVYGELNLDLTKQGHLFLDTDGHYSRPDVFELRVNDKANRNVRFASETV

SEQ ID NO: 231 - DNA, 1062 bp, Unknown
  Obtained from an environmental sample
atgagtcagatccatccaaaacttaaggtcgcggccgtgcaggctgcccccgcctttctcgatctcgatgcatcgatcgaaaagacaatacgctatgtcgacgaagcggctgcggccggggcgaagttgattgcgtttccggaaacctggattcccggctacccatggtggatctggctcggcgctccggcctgggcgatcatgcgtggcttcgtctcgcgctatttcgacaactcgctgcaatatggcagtccggaagctgaacggctgcgggacgccgccaggcgcaacaagatatacatcgccctcggcctgtccgagcgcgacgggggcagtctttatatcgcgcaatggatcatcgggcctggcggcgaaacggttgcacaacgccgcaagctcaagcccacgcacgccgagcgcactgtattcggcgaaggcgatggttcacatctggccgtgcatgatctcgatattggaagattgggcgcgctttgttgctgggaacatctgcaaccgttgtcgaaatatgcaatgtacgcccagaacgagcaaattcacgtcgccgcctggccgagcttctcgctatacgatccctttgcacacgcactcggcgccgaggtcaataacgctgcgagcaagatctatgcggtcgagggatcgtgcttcgtcattgcgccgtgcgcaacggtttcgcaggtgatgatcgatgagctctgcgatacccccgaaaagcatcaattccttcacgtcggcggcggcttcgccgtcatttacggtcccgacggctcgccactggccaaacctcttccgccagaccaggagggacttctctatgccgacatcgatctcggcatgatctcggtcgccaaggccgcagccgatcccgccggacattatgcacgtcccgatgtaactcgcctgctgttcaacaatcgcccggcaaaccgcgtcgagaagctggcgttgccggtcgatcaggaggccgaagtggatagtccgctgaaggctcccgacgcatctcccaaagtgacggcgctcaagccgtcgcaggctgcggagtag

SEQ ID NO: 232 - protein, 353 aa, Unknown
  Obtained from an environmental sample
MSQIHPKLKVAAVQAAPAFLDLDASIEKTIRYVDEAAAAGAKLIAFPETWIPGYPWWIWLGAPAWAIMRGFVSRYFDNSLQYGSPEAERLRDAARRNKIYIALGLSERDGGSLYIAQWIIGPGGETVAQRRKLKPTHAERTVFGEGDGSHLAVHDLDIGRLGALCCWEHLQPLSKYAMYAQNEQIHVAAWPSFSLYDPFAHALGAEVNNAASKIYAVEGSCFVIAPCATVSQVMIDELCDTPEKHQFLHVGGGFAVIYGPDGSPLAKPLPPDQEGLLYADIDLGMISVAKAAADPAGHYARPDVTRLLFNNRPANRVEKLALPVDQEAEVDSPLKAPDASPKVTALKPSQAAE

SEQ ID NO: 233 - DNA, 1002 bp, Unknown
  Obtained from an environmental sample
gtgagcaccatcgtcaaagccgcggccgtgcagatcagccccgtgctgtacagccgcgagggcaccgtcgagcgggtcgtgaagaagatccgggagctgggcgaaaagggcgtccagttcgccaccttccccgagaccgtcatcccttactacccgtacttttccttcgttcagacgcccttgcagatcctcgccggccccgagcatctgaagctgctcgaccagtcggtgaccgtgccgtcccccgccacggacgcgatcggccaggccgcccggcaggcaggaatggtggtgtccatcggcgtcaacgagcgtgacggcggcaccctgtacaacacgcagctgctcttcgacgcggacggcgcgctgatccagcgtcgccgcaagatcaagcccacccactacgagcgcatgatctggggcgagggcgacggctccggcctgcgcgccgtcgacagccaggtcggtcgtatcggccagctggcctgctgggagcacaacaaccccctggcgcgctacgccatgatggccgacggcgagcagatccattcggccatgtatccgggctcgatgttcggcgacccgttcgcccagaagacggaaatcaacatccggcagcatgcgctggaatccggatgcttcgtcgtctgctcgacggcctggttggacgccgatcagcaggcgcaaatcatgcaggacacgggctgcgccatcggcccgatctcgggcggctgcctcacggcgatcgtggcgcccgacggcacgttcctgggcgaaccgctcacgtcgggcgagggcgaggtcatcgccgacctcgatttcaagctgatcgacaagcgcaagcagacgatggactcgcgcggccactacaaccgccccgaactgctcagcctgctgatcgatcgaacgccgacgtcgaacgtccatgagcgcgccgcgcacccgaaggtcgaggcgtcacaaacggctggcgacacggagcggacccgcgaggtcctgtaa

SEQ ID NO: 234 - protein, 333 aa, Unknown
  Obtained from an environmental sample
VSTIVKAAAVQISPVLYSREGTVERVVKKIRELGEKGVQFATFPETVIPYYPYFSFVQTPLQILAGPEHLKLLDQSVTVPSPATDAIGQAARQAGMVVSIGVNERDGGTLYNTQLLFDADGALIQRRRKIKPTHYERMIWGEGDGSGLRAVDSQVGRIGQLACWEHNNPLARYAMMADGEQIHSAMYPGSMFGDPFAQKTEINIRQHALESGCFVVCSTAWLDADQQAQIMQDTGCAIGPISGGCLTAIVAPDGTFLGEPLTSGEGEVIADLDFKLIDKRKQTMDSRGHYNRPELLSLLIDRTPTSNVHERAAHPKVEASQTAGDTERTREVL

SEQ ID NO: 235 - DNA, 993 bp, Unknown
  Obtained from an environmental sample
atgaaaattgttaaagcggcagcagttcagctgagccccgtcctctatagccgcgaggggacggtcgaaagagtagtgcggaagattcatcaacttggtcaacagggagtgcagtttgccaccttcccggaaacagtggtgccttactacccgtatttttcgatcgtgcagtccgggtatcaaatccttcgcggcggtgagttcgtgaagctgctcgatcagtcagtgacggtgccatctcttgccaccgaagcgatcgccgaggcctgcaggcaggcgggcgtcgttgtctccatcggcgtcaatgagcgtgacggcggaactatatacaatgcgcagcttctgtttgattcggacggcacattgattcagaggcgacgcaagatcacgcccacccactacgagcgcatgatctggggccagggcgatggctcgggtctgcgggctgtggacagcaaggtggcacgtattggtcaactggcgtgctttgagcattacaaccccctcgcacgatacgcgatgatcgccgatggcgagcagatccactctgcaatgtttcccggttccatgttcggcgatggtttcgcggagaggaccgagatcgcggtcaggcagcatgcgcaggagtccggatgctttgtagtttgtgctacggcgtggctggatgccgaccagcaggctcaaattgccgcggacacaggcatcaccgacctgggaccgatctccggcggttgcttcactgcgatcattgcacctgatgggagcctgctgggtcaaccaatccgctcgggcgaaggtgacgtcattgtcgatctcgatttcactctgatcgacaggcggaagcatgttgtggactcgagaggtcactacagccggccggaattgctaagcctgctgatcgaccgtactcccacagcgcacgttcacgaacgggccgcgcactctcacttggccgccgagcaatgcttggaggatcttaacgcgcttgcttaa

SEQ ID NO: 236 - protein, 330 aa, Unknown
  Obtained from an environmental sample
MKIVKAAAVQLSPVLYSREGTVERVVRKIHQLGQQGVQFATFPETVVPYYPYFSIVQSGYQILRGGEFVKLLDQSVTVPSLATEAIAEACRQAGVVVSIGVNERDGGTIYNAQLLFDSDGTLIQRRRKITPTHYERMIWGQGDGSGLRAVDSKVARIGQLACFEHYNPLARYAMIADGEQIHSAMFPGSMFGDGFAERTEIAVRQHAQESGCFVVCATAWLDADQQAQIAADTGITDLGPISGGCFTAIIAPDGSLLGQPIRSGEGDVIVDLDFTLIDRRKHVVDSRGHYSRPELLSLLIDRTPTAHVHERAAHSHLAAEQCLEDLNALA

SEQ ID NO: 237 - DNA, 993 bp, Unknown
  Obtained from an environmental sample
atgaaagtcgtcaaagccgccgcagtgcagatcagtcctgttctctacagccgagaggcaaccgtcgccaaggtcgtgcagaagatccacgaactcggccagaaaggcgtgcagttcgccacctttccagagaccgtagtgccttactacccgtacttttccgccgtccagacaggcatcgagcttctgtccggcacggagcatctccggctgctcgatcaggccgtgacggtgccgtctgccgctaccgacgcgatcggagaggcagcccggaaggcaggcatggtggtgtcgatcggcgtcaatgaacgcgatggcggcaccttgtacaacacacagttgctcttcgatgccgatggcaccttgatccagcgccgccgcaagatcacgccgacccacttcgaacgcatgatctggggccagggggacggttcgggcctgcgcgctgtcgacagcaaggtcggtcgcattggccagttggcctgcttcgagcacaacaacccgctggcccgctacgcgttgattgccgacggcgagcagatccattccgccatgtatccgggttctgcttttggcgaaggatttgcccaaaggatggaaatcaatatccgccagcatgcgctggagtcgggtgcgttcgtcgtcaacgcaacggcctggctggatgctgaccagcaggcgcagatcatgaaggacaccggctgcgggattggcccgatctcgggcggttgcttcaccacgatcgtgtcacccgacggcatgctgatggccgaacccctgcgctcgggcgagggtgaggtcatcgtcgatctcgacttcacgctgatcgaccgtcgcaagatgttgatggactcggcgggccactataaccgcccggaactgctcagtctcatgatcgaccgcaccccgaccgcgcacgttcatgaacgcgctgcgcgtccggtgtcgggcgttgagcagaacccggaggaacttcgcatcccggccgcgtga

SEQ ID NO: 238 - protein, 330 aa, Unknown
  Obtained from an environmental sample
MKVVKAAAVQISPVLYSREATVAKVVQKIHELGQKGVQFATFPETVVPYYPYFSAVQTGIELLSGTEHLRLLDQAVTVPSAATDAIGEAARKAGMVVSIGVNERDGGTLYNTQLLFDADGTLIQRRRKITPTHFERMIWGQGDGSGLRAVDSKVGRIGQLACFEHNNPLARYALIADGEQIHSAMYPGSAFGEGFAQRMEINIRQHALESGAFVVNATAWLDADQQAQIMKDTGCGIGPISGGCFTTIVSPDGMLMAEPLRSGEGEVIVDLDFTLIDRRKMLMDSAGHYNRPELLSLMIDRTPTAHVHERAARPVSGVEQNPEELRIPAA

SEQ ID NO: 239 - DNA, 969 bp, Unknown
  Obtained from an environmental sample
atgtccaatgagaataagtatgacacatttaaagttgctgcagtccaggccacacctgtgtttcttgatcgtgaagcaaccatcgacaaagcttgcgagttgattgctactgcaggtcgtgaaggtgctcgcctgattgtctttccagaagcgttcatcccatcctatcccgagtgggtatggggtattccctctggtgagcaaggtttactcaacgaactttattcagagttgctcaccaatgcggttaccatacccagcgacgcgactgacagattgtgcgaggcggcaaagcttgcgaatgcctatgtagtgatgggaatgagcgaacggaatgtcgaagcgagtggtgcaagcctgtataacacgatgttgtatatagatgcacagggggagattttagggaaacatcggaagctggtgccaacgggtggtgaacgcctggtatgggcgcaaggtgatggcagcacgctgcaggtctacgatactccattgggaaaacttggtgggttaatttgctgggaaaattatatgccgctggcacgctatacgatgtatgcctggggaacacaaatctatgttgcagcaacgtgggattgcggccaaccctggctctcaacgatacggcatattgctaaagaaggcagggtatacgtggttggttgctgtatcgcgatgcgtaaagatgatattccagatcgttactctatgaagcagaaatattatgctgaaatggatgaatggataaatgttggggatagcgcgattgtcaatcccgaaggacattttattgcagggcctgtgcgcaagcaagaagaaattctctatgcggagattgatccacgtatgatgcaaggcccgaagtggatgcttgacgtggcgggacattatgcaagaccagatgtgttccagttgacggtgcatacggatgtgaggcagatgatacgggtggaagatgattctcaatga

SEQ ID NO: 240 - protein, 322 aa, Unknown
  Obtained from an environmental sample
MSNENKYDTFKVAAVQATPVFLDREATIDKACELIATAGREGARLIVFPEAFIPSYPEWVWGIPSGEQGLLNELYSELLTNAVTIPSDATDRLCEAAKLANAYVVMGMSERNVEASGASLYNTMLYIDAQGEILGKHRKLVPTGGERLVWAQGDGSTLQVYDTPLGKLGGLICWENYMPLARYTMYAWGTQIYVAATWDCGQPWLSTIRHIAKEGRVYVVGCCIAMRKDDIPDRYSMKQKYYAEMDEWINVGDSAIVNPEGHFIAGPVRKQEEILYAEIDPRMMQGPKWMLDVAGHYARPDVFQLTVHTDVRQMIRVEDDSQ

SEQ ID NO: 241 - DNA, 972 bp, Unknown
  Obtained from an environmental sample
atgatatccaacgagcataacaatactccattcaaggttgctgctgtgcaggctacacctgtgtttcttgatcgcgaagcaacgatcgataaagcgtgtgaactgatcgctactgccggtcatgaaggcgctcgtttgattgtttttccagaagcgttcatcccatcctatcccgagtgggtatggggaattccctctggcgagcaaggtttgctcaacgatctgtatgcagagttactcaccaattcagttacgatacccagcaacgcaactgacaggctttgtagagccgcgaagcttgctaatgcctacgtggtgatggggatgagcgaacggaatatcgaagcgagcggcgcaagcctgtacaatacgatgttatatatagatgcacagggtgagattttgggcaaacatcgaaagctggtgccaacgggcggagaacgcctggtatgggcacaaggagatggaagcacgctgcaggtttacgatacacctctaggaaagcttggtggtttaatttgctgggaaaattatatgccgctggcacgctacgctatgtatgcctggggaactcaaatctacgtcgcggcaacgtgggatcgcggccaaccctggctctcaacgatacggcatatcgctaaagagggcagggtatacgtaatcggttgctgtatcgcgatgcgtaaagacgatattccagataggtactccatgaagcagaagtattatgcggagatggatgaatggatcaacgtaggtgacagcgcgattgtcaatcctgagggggacttcattgcggggcctgtgagcaagcaggaggaaattctctatgcggagattgatccgcggatggtgcaaggtccgaagtggatgctggatgtggcggggcattacgcgaggcctgatgtgttcgagttgacggtgcatacggatgtgagggagatgatgcgggtggagcatgattatcaatga

SEQ ID NO: 242 - protein, 323 aa, Unknown
  Obtained from an environmental sample
MISNEHNNTPFKVAAVQATPVFLDREATIDKACELIATAGHEGARLIVFPEAFIPSYPEWVWGIPSGEQGLLNDLYAELLTNSVTIPSNATDRLCRAAKLANAYVVMGMSERNIEASGASLYNTMLYIDAQGEILGKHRKLVPTGGERLVWAQGDGSTLQVYDTPLGKLGGLICWENYMPLARYAMYAWGTQIYVAATWDRGQPWLSTIRHIAKEGRVYVIGCCIAMRKDDIPDRYSMKQKYYAEMDEWINVGDSAIVNPEGDFIAGPVSKQEEILYAEIDPRMVQGPKWMLDVAGHYARPDVFELTVHTDVREMMRVEHDYQ

SEQ ID NO: 243 - DNA, 999 bp, Unknown
  Obtained from an environmental sample
atgaagcaaactcgagtagcgatcattcaggcggaacctgtatatctcaatttgcaagcgagtgttgcgagggctatcgatcttgccggacgcgccgcgaagcaaggagcgcgtctgatagtgtttggagagacctggttgccgggttatcccgcgtggctggattactgtcccggcatggcgttctgggatcaccggccgacaaaagaagtgtttgcccggacccgcgagaacagtgttgtaattccgggaaaggaaatcgaacagctctgtaaaactgcggcggagctgggagttgtaatttcgatcggtgtaaacgaaaaaattctggaaggccccggaaacggcacgctctacaattctcttttgctgattgatgaatcaggaaaactggccggccatcaccgcaaactggttccgacttatacggaacggatggtgtggggaatgggtgatggaggtggaatggaagccatatcgactgcagccggcagggttggcggattgatttgctgggagcactggatgccattgagccggcaggtgctgcacatgtcgggtgaggaaattcatgtggcagtgtggcccacggttcatgaggtgcaccagcttgcatcacgccattatgcatttgaagggcgttgttttgtgctcgcagccggattgttgatgaaggtccgggatattcctccggagctggaattgccttctcagatgtcgcgtgaatccgaagactggcttctgcgcggcgggagcgccgtcattggtccggatggaaagtacattgtggagccgttgtttgatcgagaggcgattctcacagccgatcttgaattagccgcatgcgatcgtgaaaaaatgacgctggacgtaacgggacattattcccgccccgatctttttcacctggaattcaggaaacagcaatccggccatattgcgggagcaggaacgatcagccggcaaaaatcagcgccggaccgcgcggacgatcactaa

SEQ ID NO: 244 - protein, 332 aa, Unknown
  Obtained from an environmental sample
MKQTRVAIIQAEPVYLNLQASVARAIDLAGRAAKQGARLIVFGETWLPGYPAWLDYCPGMAFWDHRPTKEVFARTRENSVVIPGKEIEQLCKTAAELGVVISIGVNEKILEGPGNGTLYNSLLLIDESGKLAGHHRKLVPTYTERMVWGMGDGGGMEAISTAAGRVGGLICWEHWMPLSRQVLHMSGEEIHVAVWPTVHEVHQLASRHYAFEGRCFVLAAGLLMKVRDIPPELELPSQMSRESEDWLLRGGSAVIGPDGKYIVEPLFDREAILTADLELAACDREKMTLDVTGHYSRPDLFHLEFRKQQSGHIAGAGTISRQKSAPDRADDH

SEQ ID NO: 245 - DNA, 999 bp, Unknown
  Obtained from an environmental sample
atgggtgagaatgccaacttcaccgtcgcagctgtccaggcaacgccggtcttcttagaccgggatgcgacggtcgagaaggcttgcgagctcatcgctgaagccgggcgaaacggagcgcgcctggccgtttttcccgaggcgtttgtgccggcttacccggactgggtctgggctgttccgccgggcgattcaaggctgctgcacgagctctacggtgagctgatccagaactctgtcacgattcccagcgagtcgacggagaaactctgccgggccgcccgcggggccaaagtctgcgtggcgatcggcatcaacgagaggaatgcggaggcaagcgggggtagcctctacaacagcctcctgtacatcagcccggacggccaggtcctcgggaagcaccgcaagctcgttcccaccggagcggagcggcttgtctgggcgcagggcgacggcagcactatcgacgtgtttgagttgcctttctgtcgtttgggtggcctcatctgttgggagaactacatgccgctggcccgttatgcgatgtacgcctggggcacgcaggtctacgtcgcggcaacgtgggaccacggcgaaccttggctctcaaccttgaggcatatcgccagggaggggcgtgcatatgtcattggcgtttgcatgccgatgcgcatgagcgacatcccggaccgatacgagttcaagcgcaagtactatggcgggcgcgactggatcaatactggtgacagcgccatcgtgggtccggacggaaacttcatcgccggccccctgagcgagcgcgaagagatcctgtacgccgatatagacctgaatcggcttgcgaactcgaagtggatgctggacgtcgccgggcactatgcacggccggacgtcttccagttgaccgttaaccgcgagccgaacccgatgatctctgaggatgggcacaagacggttcccacgctaccgaaacgtgcggggaagagtaggacgagatga

SEQ ID NO: 246 - protein, 332 aa, Unknown
  Obtained from an environmental sample
MGENANFTVAAVQATPVFLDRDATVEKACELIAEAGRNGARLAVFPEAFVPAYPDWVWAVPPGDSRLLHELYGELIQNSVTIPSESTEKLCRAARGAKVCVAIGINERNAEASGGSLYNSLLYISPDGQVLGKHRKLVPTGAERLVWAQGDGSTIDVFELPFCRLGGLICWENYMPLARYAMYAWGTQVYVAATWDHGEPWLSTLRHIAREGRAYVIGVCMPMRMSDIPDRYEFKRKYYGGRDWINTGDSAIVGPDGNFIAGPLSEREEILYADIDLNRLANSKWMLDVAGHYARPDVFQLTVNREPNPMISEDGHKTVPTLPKRAGKSRTR

SEQ ID NO: 247 - DNA, 990 bp, Unknown
  Obtained from an environmental sample
atgccgacccccaaggaaaagtttagaatcgccgccgttcaggcttgccccgtttttctggaccggggggagacggtaaagaaggcctgccggctggcggccgaggccgggggccagggcgcccggctgatcgtgtttccggagtccttcatccccgcttacccggactgggtgtgggccgttccgccggggagggagaagctcctgaatgaaatgtacgccgaattcctggccggcgcggtggaagtcccggggccggtgacggaggaattgggccgggcggcggaaagggccggcgcttacctggtcatgggggtcaccgagcgggacaccgaggccagcggggcaagcctgtacaacaccctcctctatttcggtccccagggaagcctgctgggaaaacaccgcaaactggtgcccacgggaggggaacggaccgtctgggcccggggggacggcagcacgctgcaggtgtacgatacccccctgggaaagatcggcggcctgatctgctgggagaactacatgcccctggcccgctacgccatgtatgcgtggggcactcagatttacctggcccccacctgggaccggggggaaccctggctttcaaccctgcggcacatcgccaaggaagggcgggtttacgtggtggggtgctgcatggctatgcaaaaaggggacatcccggatcgcttcgaatacaagcaaaaatactatcccgcagcccgggagtggatcaacacgggcgacagcgccatcctgaacccggagggggaattcatcgccgggccggcgggaaagaaggaagagatcctgtacgctgaaatagacccccggcagatgggggggcccaagtggatgctggacgtggccggccattacgcccggccggatgtcttcgaactgatcgttcaccgggaggcccggccgatgatccgggtgacggaagcgccgtctccgggagagaaagaaacgggtgaaggatag

SEQ ID NO: 248 - protein, 329 aa, Unknown
  Obtained from an environmental sample
MPTPKEKFRIAAVQACPVFLDRGETVKKACRLAAEAGGQGARLIVFPESFIPAYPDWVWAVPPGREKLLNEMYAEFLAGAVEVPGPVTEELGRAAERAGAYLVMGVTERDTEASGASLYNTLLYFGPQGSLLGKHRKLVPTGGERTVWARGDGSTLQVYDTPLGKIGGLICWENYMPLARYAMYAWGTQIYLAPTWDRGEPWLSTLRHIAKEGRVYVVGCCMAMQKGDIPDRFEYKQKYYPAAREWINTGDSAILNPEGEFIAGPAGKKEEILYAEIDPRQMGGPKWMLDVAGHYARPDVFELIVHREARPMIRVTEAPSPGEKETGEG

SEQ ID NO: 249 - DNA, 1017 bp, Unknown
  Obtained from an environmental sample
atgggcattcaacatccgaaatatcgcgtcgcggtggtgcaggcggcaccggcctggctcgacctcgaggcgtcggtcagcaagagcatcgcgctgatagaggaggccgccgccaagggcgccaagctgatcgcgttccccgaggccttcatccccggctatccctggtacatctggctggactcgccggcctgggcgatcggccgcggcttcgtgcagcgctatttcgacaattcgctcagctatgacagcccgcaggcggagcgcctgaggctcgcagtgaagaaggccggcatgaccgcagtgctcggcctgtccgagcgcgacggcggcagcctctatctcgcgcaatggttgatcggacccgacggcgagaccatcgcaaagcggcgcaagctgcggccgacccatgccgagcgcaccgtctacggcgagggcgacggcagcgaccttgcggtgcatgaccgccccggcatcggccggctcggtgcgctgtgctgctgggagcatctgcagccgctgtcgaaatacgcgatgtacgcccagaacgagcaggtgcatgtcgcggcctggccgagcttctcgctgtacgatccgttcgcgccggcgctcggctgggaggtcaacaatgcggcctcgcgcgtctatgccgtcgagggctcctgcttcgtgctggcgccctgcgccaccgtctcgcaggcgatgatcgacgagctctgcgaccgcgacgacaagcatgcgctgctgcatgttggcggcggccatgccgcgatcttcggccccgacggcagcgcgatcgcggacaagcttccgtccgaccaggagggcctcctgttcgccgacatcgatctcggcgcgatcgggatcgcgaagaatgccgctgatccggccgggcactattcgcgcccggacgtgacgcggctgctgctcaacaagaagccctcgaagcgcgtcgagcacttcgcgctgccgctcgacacgctcgcgggcgaggagatcgacgcggccgcaagctaa

SEQ ID NO: 250 - protein, 338 aa, Unknown
  Obtained from an environmental sample
MGIQHPKYRVAVVQAAPAWLDLEASVSKSIALIEEAAAKGAKLIAFPEAFIPGYPWYIWLDSPAWAIGRGFVQRYFDNSLSYDSPQAERLRLAVKKAGMTAVLGLSERDGGSLYLAQWLIGPDGETIAKRRKLRPTHAERTVYGEGDGSDLAVHDRPGIGRLGALCCWEHLQPLSKYAMYAQNEQVHVAAWPSFSLYDPFAPALGWEVNNAASRVYAVEGSCFVLAPCATVSQAMIDELCDRDDKHALLHVGGGHAAIFGPDGSAIADKLPSDQEGLLFADIDLGAIGIAKNAADPAGHYSRPDVTRLLLNKKPSKRVEHFALPLDTLAGEEIDAAAS

SEQ ID NO: 251 - DNA, 978 bp, Unknown
  Obtained from an environmental sample
gtgaccatcgtgagagctgccgccgtgcagatcagtcccgtgctctacagccgggaagccaccgtagaaaaagtcgttcgcaagatccgcgaactgggaagaaacggcgtgcagttcgccaccttcccggaaaccctggtgccctactacccgtacttcgcggccgtgcagacgggcatcgaactgctgtccggcaaggagcacctgcgactgctggaacaatccgtaacggttccctcgcccgccaccgatgccattgcccaggcggcacgcgaagccggcatggtggtgtccatcggtgtcaacgagcgcgacggaggcaccatctacaacacgcagctgctgtttgacgccgacggcacgctggtacagcgccgccgcaagatcacgccgacgcatttcgagcgcatggtctggggccagggcgacggctcgggcctgcgagccgtggacaccaaggccggccgcatcggtcagctcgcctgcttcgagcacaacaacccgctggcgcgctacgccatgatcgccgacggtgagcagatccattcggccatgtacccgggctctgccttcggcgagggcttcgcgcagcgcatggaaatcaacatacgccagcacgccctggagtctggctgcttcgtggtgaatgcgaccgcgtggctggatgccgaccagcaggcgcagatcatgaaggatacgggctgcggcatcggcccgatctccggcggctgcttcacgaccatcgtcacgccggacggcatgctgatcggtgaacccctccgcgaaggcgaaggcgaagtcatcgccgacctcgatttcaccctgatcgaccggcgcaagctgctggtggactcggtgggccactacaaccgtccggagctgctgagcctgctgatcgatcgcacccctgcggcgaacttccatgagcgcaatgcgcttccgtccgtcaacaccgccagcagcctcgaaatcgtctga

SEQ ID NO: 252 - protein, 325 aa, Unknown
  Obtained from an environmental sample
VTIVRAAAVQISPVLYSREATVEKVVRKIRELGRNGVQFATFPETLVPYYPYFAAVQTGIELLSGKEHLRLLEQSVTVPSPATDAIAQAAREAGMVVSIGVNERDGGTIYNTQLLFDADGTLVQRRRKITPTHFERMVWGQGDGSGLRAVDTKAGRIGQLACFEHNNPLARYAMIADGEQIHSAMYPGSAFGEGFAQRMEINIRQHALESGCFVVNATAWLDADQQAQIMKDTGCGIGPISGGCFTTIVTPDGMLIGEPLREGEGEVIADLDFTLIDRRKLLVDSVGHYNRPELLSLLIDRTPAANFHERNALPSVNTASSLEIV

SEQ ID NO: 253 - DNA, 924 bp, Unknown
  Obtained from an environmental sample
atgtcaaacgagaaccacaaccaaacattcaaagttgccgcggtgcaggccacacctgtattcctcgatcgtgaagcgaccatcgacaaagcttgcgagttgattgctgcagccggcaatgaaggggcgaggctggttgtcttcccggaggcattcatcccgtcctatccagattgggtatgggcaatcccaccgggcgaagaaggcgtgctcaatgagttgtacgcggaactgctctccaattcggtcacgattcccagtgacgtgacggatagactgtgccgggccgcgaggcttgccaatgcctacgtagtgatggggatgagcgaatgcaatgccgaggccagtggcgcaagcctgtataacacgctattgtacatcgatgcgaagggtgaaatcctgggtaaacatcgaaagttggtgccaactggcggcgagcgactggtgtgggcacagggcgatggcagcacgctgcaggtctacgatactccactgggtaaactcggcggtttaatttgctgggagaattatatgccgctggcccgctacaccatgtacgcctggggcacacaaatctatatcgcagcgacatgggatcgcgggcaaccctggctctccaccttgcggcatatcgccaaagaaggcagggtgtacgtgatcggctgttgtatcgcgatgcgcaaagatgatatcccagagcgttacccaatgaagcagaagttttacgcggaggccgatgagtggatcaatataggcgacagcgcgatcgtcaatcctgaagggcagtttatcgcggggccggtacgcaaacaggaagagattctctacgcggagattaatccgcgcatggtgcaaggcccgaagtggatgctcgacgtggcagggcactacgccaggccggacgtattccagttgacagtgtaa

SEQ ID NO: 254 - protein, 307 aa, Unknown
  Obtained from an environmental sample
MSNENHNQTFKVAAVQATPVFLDREATIDKACELIAAAGNEGARLVVFPEAFIPSYPDWVWAIPPGEEGVLNELYAELLSNSVTIPSDVTDRLCRAARLANAYVVMGMSECNAEASGASLYNTLLYIDAKGEILGKHRKLVPTGGERLVWAQGDGSTLQVYDTPLGKLGGLICWENYMPLARYTMYAWGTQIYIAATWDRGQPWLSTLRHIAKEGRVYVIGCCIAMRKDDIPERYPMKQKFYAEADEWINIGDSAIVNPEGQFIAGPVRKQEEILYAEINPRMVQGPKWMLDVAGHYARPDVFQLTV

SEQ ID NO: 255 - DNA, 1005 bp, Unknown
  Obtained from an environmental sample
atgacaatgtctaagaccaaatttagggttgcagctgtgcaggcggcgccggttttccttgatcgggaagcgacgttggataaagcttgtggattgattgaggaggcgggccgcaacggcgccagcctcgtcgtcttccctgagtcattcattccggcctaccccgattgggtttgggctgtgccggcgggcgaagaagctttactcaatgaactgtacgcacaactgttggccaacgccgttgaaattcccggcccggccactcaacgtttgagccaggcggctaaaaaggctaaggttcacctggctatgggcctgaccgaacgcaacagcgaggccagcggcggcagcctttacaacaccttgctctatcttgacccgcagggccacattctgggcaagcatcgtaagctggtgcccaccggcggtgagcggctggtttgggcccagggcgacggcagcactttgcaagtttacgatacgcctctgggtaaactcagcggcctgatttgctgggaaaattatatgccgctggcgcgctacgcgctgtatgcctggggtacgcaaatttatattgcggccacctgggatcggggtgagccgtggctttcgacgttgcggcatattgccaaagagggccgggtgttggtcatcggttgcggtatggccttgcgcaaggctgatattcctgatcattttgaattcaagcagcgcttttatcaaaacgccgccgagtggatcaacgggggcgacagcgccattgtcaaccctgatggtgaatttattgctggccccttaagcgagcaggaaggcattttgtacgccgagattgatccggcccagatgggcgggccaaagtggatgctcgacgtggccgggcattacgctcgcccggatgtgtttgaactgacggtccataccgccgcccgacccatgatcacctcgaaaaaggatggcctaacacccgccgaggccgttacgcaagtaacgaaagcattattgtaa

SEQ ID NO: 256 - protein, 334 aa, Unknown
  Obtained from an environmental sample
MTMSKTKFRVAAVQAAPVFLDREATLDKACGLIEEAGRNGASLVVFPESFIPAYPDWVWAVPAGEEALLNELYAQLLANAVEIPGPATQRLSQAAKKAKVHLAMGLTERNSEASGGSLYNTLLYLDPQGHILGKHRKLVPTGGERLVWAQGDGSTLQVYDTPLGKLSGLICWENYMPLARYALYAWGTQIYIAATWDRGEPWLSTLRHIAKEGRVLVIGCGMALRKADIPDHFEFKQRFYQNAAEWINGGDSAIVNPDGEFIAGPLSEQEGILYAEIDPAQMGGPKWMLDVAGHYARPDVFELTVHTAARPMITSKKDGLTPAEAVTQVTKALL

SEQ ID NO: 257 - DNA, 942 bp, Unknown
  Obtained from an environmental sample
atgaacaagatcgcgatcattcagcgcccacccgtgctactcgaccgcatcgccacgctggcggttgcggtggagtcgatcgacgaagctgccgcagccggtgcctcactgatcgttcttccagaaaccttcatccccggctacccgtcctggatctggcgtctcgcgccggggagggatggtgcgctcattgcccagttgcatgcccgactgctcgccaacgcggtcgatcttgcggctggagatctggatgccctgtgtgaagttgcgcacggccaccgggtgaccgtggtgtgcggcctcaacgaatgcgagcgcagtcgcggcgggggcactctctacaacacggtcgtcgtgatcgaccccgacggcaagctgtgcaatcgccaccgcaagctgatgccgaccaacccggaacgcatggtgcacggtctgggtgatgcatcgggcctgcgcgccgtcgacaccccggtgggtcgagtgggcgcactcatctgctgggaaaactatatgccgctggcacgctacgcactttacgccgagggggtggaagtctacgtggcgcccacctatgacagcggcgatggctggatcagtacgatgcgtcatattgcgcttgagggacgctgctgggtgctgggtagcggaaccgtactgcgtggcagcgacgtcccagaagactttccgtcacacctggacctgtttcccgacgcggaggaatggatcaatccgggcgactcggtggtcgtcgatcctcagggcaagatcgtcgcaggcccgatgcgacgtgagacaggcattctctacgcagaaatcgacgccgaacgggtcgcgccttcgcgccgcacgctcgatgtcgccggacactacgcccgcccggatattttcgagctccatgtccgacgtacgccggcgatgccggtccacgccgttgatgcatga

SEQ ID NO: 258 - protein, 313 aa, Unknown
  Obtained from an environmental sample
MNKIAIIQRPPVLLDRIATLAVAVESIDEAAAAGASLIVLPETFIPGYPSWIWRLAPGRDGALIAQLHARLLANAVDLAAGDLDALCEVAHGHRVTVVCGLNECERSRGGGTLYNTVVVIDPDGKLCNRHRKLMPTNPERMVHGLGDASGLRAVDTPVGRVGALICWENYMPLARYALYAEGVEVYVAPTYDSGDGWISTMRHIALEGRCWVLGSGTVLRGSDVPEDFPSHLDLFPDAEEWINPGDSVVVDPQGKIVAGPMRRETGILYAEIDAERVAPSRRTLDVAGHYARPDIFELHVRRTPAMPVHAVDA

SEQ ID NO: 259 - DNA, 981 bp, Unknown
  Obtained from an environmental sample
atggccatcatcaaagccgccgccgtccagatcagtccggtgctgtatagccgcgagggaaccgtggacaaggtctgccagcagatcatcgccctcggtcagcaaggcgtgcaatttgcggtctttccggaaacggtggtgccgtactacccctatttctccttcgtccagccgccgttcgccatgggcaaggaacacctgaaactgttggaacaatcggtgattgtgccgtcggctgccaccttggcgatcggcgaagcgtgcaaacaagcgggaatggtggtgtctatcggcgtcaatgagcgcgatggcggcacgatctacaacgcccagttgctgtttgacgctgatggcagcttgattcagcaccgtcgcaaaataaccccgacgtaccacgagcggatgatctggggtcaaggcgacggctccgggttgcgcgccatcgacagcgcggtcgggcgtattggctcgctggcctgctgggaacattacaaccccttggcccgctacgccctgatggccgacggcgagcagattcacgcggctatgtttcccggctctctggtgggtgacatttttgccgatcagatagaggtcactattcgtcatcacgccttggagtccggctgcttcgtggtcaactccaccgcgtggcttgatgctgatcagcaaggccaaatcatgcaggacaccggttgcagcattggcccaatctcgggtggctgcttcacggccatcgtttccccggaaggcaaattactcggcgaaccgctgcgttcaggtgagggcgcagtcatcgccgacctggacatggcattgatcgacaagcgcaaacggatgatggattccgtcggccattacagccgcccagaactgctcagtttattgatcgaccgcacgcccaccgctcatgtgcatgagcgcggcgcccatcaccttgccgtagcctctatcggggagcttgaccatgcaaaccaatga

SEQ ID NO: 260 - protein, 326 aa, Unknown
  Obtained from an environmental sample
MAIIKAAAVQISPVLYSREGTVDKVCQQIIALGQQGVQFAVFPETVVPYYPYFSFVQPPFAMGKEHLKLLEQSVIVPSAATLAIGEACKQAGMVVSIGVNERDGGTIYNAQLLFDADGSLIQHRRKITPTYHERMIWGQGDGSGLRAIDSAVGRIGSLACWEHYNPLARYALMADGEQIHAAMFPGSLVGDIFADQIEVTIRHHALESGCFVVNSTAWLDADQQGQIMQDTGCSIGPISGGCFTAIVSPEGKLLGEPLRSGEGAVIADLDMALIDKRKRMMDSVGHYSRPELLSLLIDRTPTAHVHERGAHHLAVASIGELDHANQ

SEQ ID NO: 261 - DNA, 1014 bp, Unknown
  Obtained from an environmental sample
atgggtctggttcatcagaaatacaaggtagcggtggttcaggcggcaccggtttttctcgatctcgatgcaaccgtggacaagaccattgcgctgatcgaggaagcttccgcgcaaggcgcaaaactggtcgcgtttcccgagaccttcattcccggatatccgtggcagatctggctcggcgcgccggcctgggcgatcggccgcggctttgtgcagcgctacttcgacaattcgctgggcttcgacagcccgcaggcggaaaaaatccgccaggccgtgaagcgcgccaagctgaccgcggtgcttgggctatccgaacgcgacggcggcagcctctatatcgcgcagtggctgatcggccctgacggcgagaccatcgccaagcgccggaaactgcgtccgacccatgccgaacgcaccgtgttcggcgaaggcgacggcagcgatcttgcggtccacgatcgcgccgacgtcgggcgcttgggcgcactgtgctgctgggagcacctgcagccgctatcgaaatacgcgatgtacgcccagaacgaacaggtgcatgtcggcgcctggccgagcttttcgctgtacgatccgttcgcacatgcgctcggccatgaggtcaacaacgccgccagcaaggtctatgcggtcgaaggctcctgcttcttcctgggtccctgcgctgtcgtctcgcaggcgatgatcgacgagctctgcgactctcccgagaaacatgccttcctgcatgtcggcggcggccacgcggtgatctacggcccggacggcagttcgctggccgagaaactcccgcccgaccaggaaggcattctgtacgccgatatcgatctcggcatgatcggggtcgcgaagaacgccgccgatccggccgggcattattcgcggcccgacgtcacgcggctgttgctcaacaccacgcgcgccaaccgcgtcgagcatttctcgcttcccgtcgatgccgaggtcatgagcgaaatcaggctgcaggcctga

SEQ ID NO: 262 - protein, 337 aa, Unknown
  Obtained from an environmental sample
MGLVHQKYKVAVVQAAPVFLDLDATVDKTIALIEEASAQGAKLVAFPETFIPGYPWQIWLGAPAWAIGRGFVQRYFDNSLGFDSPQAEKIRQAVKRAKLTAVLGLSERDGGSLYIAQWLIGPDGETIAKRRKLRPTHAERTVFGEGDGSDLAVHDRADVGRLGALCCWEHLQPLSKYAMYAQNEQVHVGAWPSFSLYDPFAHALGHEVNNAASKVYAVEGSCFFLGPCAVVSQAMIDELCDSPEKHAFLHVGGGHAVIYGPDGSSLAEKLPPDQEGILYADIDLGMIGVAKNAADPAGHYSRPDVTRLLLNTTRANRVEHFSLPVDAEVMSEIRLQA

SEQ ID NO: 263 - DNA, 1014 bp, Unknown
  Obtained from an environmental sample
atgaaagtcgtcaaagcggcagcggttcagttgagccctgtcctctacagccgcgaggcaaccgtcgcgaaggtcgtgcggaagatccacgagcttgggcagcagggcgtgcagttcgccaccttcccggaaaccgttgtgccgtactacccgtatttctccgcggtccagacgccgatgcagcttctggctggaaccgagcatctgaaattgctcgaccaggccgtgacggtgccgtctcccgcgaccgacgcgatcggcgaggcagcccggaaggcgggcatggtggtgtccatcggcgtcaacgagcgtgatggtggaaccctgtacaacacccaattgctcttcgacgccgatggcaccctgatccagcgccgccgcaagatcacgcccacccatttcgagcgcatgatctggggccagggtgacgggtcgggcctgcgtgccgtcgacagcaaggtcggccgcattggccagctggcatgcttcgagcacaacaatcctctggcgcgctacgcgatgatggccgacggcgagcagatccattcggccatgtatccgggttctgccttcggcgagggctttgcccagaggatggaaatcaatatccgccagcacgcactggagtccgggtgcttcgtcgtgaacgcgacggcctggctggatgccgaccagcaggcgcaaatcatgaaagacacgggctgcgggatcggtccgatctcgggcggttgcttcaccacgatcgtggcacccgacggcacgctgctgggggaacctctgcgctcgggcgagggcgaggtcatcgccgatctcgatttcacggagatcgaccggcgcaagatgctgatggactcggcaggccactacaaccgtccggaactgctcagtctgctgatcgaccgcacgccgaccgcaaacgtgcacgaacggatggcgcatccccaagcgagcacgaagcagccgcgctccggcgatctgcccgctgcgctggctggcgcgcaggagatcctgtga

SEQ ID NO: 264 - protein, 337 aa, Unknown
  Obtained from an environmental sample
MKVVKAAAVQLSPVLYSREATVAKVVRKIHELGQQGVQFATFPETVVPYYPYFSAVQTPMQLLAGTEHLKLLDQAVTVPSPATDAIGEAARKAGMVVSIGVNERDGGTLYNTQLLFDADGTLIQRRRKITPTHFERMIWGQGDGSGLRAVDSKVGRIGQLACFEHNNPLARYAMMADGEQIHSAMYPGSAFGEGFAQRMEINIRQHALESGCFVVNATAWLDADQQAQIMKDTGCGIGPISGGCFTTIVAPDGTLLGEPLRSGEGEVIADLDFTEIDRRKMLMDSAGHYNRPELLSLLIDRTPTANVHERMAHPQASTKQPRSGDLPAALAGAQEIL

SEQ ID NO: 265 - DNA, 999 bp, Unknown
  Obtained from an environmental sample
atgcttaatctaggcatagtccagatgaacgcagagccgctcaacgtggaaggcaacctgctcaaggcggagcgctatgtcgcgaagtgcgccgcggacggcgcccaactcgtggtgctgccggagatgttcaacgtcggcttccacctcggcgagtccctgatgatggtcgccgagcccctggacggcaagaccgtgcagtggctgcaacggcaggcgtccacccataacatatatatcaccgggagcttatacgagcgttacgacgagcatttctacaacaccatggtcatggtgggatacgacggcagcgtgcagtactaccgcaagcgcaatcctacctggtccgagtcggcggtgtggcgccgcagcgaggtgccaggccccggtatattcgataccccgttcgggcgcatcgggggcgtcatctgcttcgattccttcgcgcgcgagacccacgagggcttcaagcagagcggggtcgaggcggtggtaatcatcgccctgtggggcgccaaccgtgcgcgggcattcttctggcgcccggacctcctgctaagccgggaagggctggtccgttggtcccggctggcctcggaggacgtcccccgaaatcacgcgaaagagctcggggtcccggtcgccttcgtcaaccagagtggcaccatccgcatgaccagccccatccctttccccgactggccggtgcagagctccttctacgacttcatcggcaagtcccacgtccgggacgcatccggagaggtgatcgcgagggtggacgagggggagatcgactcctgcctggtggtcccggtagaggtcgagcaggcgcagagcaggccggagatcaggaagtcaaatatatcgcccggctacctcggcaaggattactatttcgtggagccgccgcttatctgcaagctcttccaggtctggttcctcagcggcctggtgcccaccgaatacgaggcgcggcgtctgcgccacctgttctga

SEQ ID NO: 266 - protein, 332 aa, Unknown
  Obtained from an environmental sample
MLNLGIVQMNAEPLNVEGNLLKAERYVAKCAADGAQLVVLPEMFNVGFHLGESLMMVAEPLDGKTVQWLQRQASTHNIYITGSLYERYDEHFYNTMVMVGYDGSVQYYRKRNPTWSESAVWRRSEVPGPGIFDTPFGRIGGVICFDSFARETHEGFKQSGVEAVVIIALWGANRARAFFWRPDLLLSREGLVRWSRLASEDVPRNHAKELGVPVAFVNQSGTIRMTSPIPFPDWPVQSSFYDFIGKSHVRDASGEVIARVDEGEIDSCLVVPVEVEQAQSRPEIRKSNISPGYLGKDYYFVEPPLICKLFQVWFLSGLVPTEYEARRLRHLF

SEQ ID NO: 267 - DNA, 1038 bp, Unknown
  Obtained from an environmental sample
atgggcattacgcatccgaagttcaaggccgcggcggtacaggcggcgccgggctttctcgacagcgaggccaccgtcgacaagacgatccgcctgatgcaggaagcggcggaccacggcgcctcgctgatcgtctttccggaagcctggctgcccggttatccgtggtggatctggctcggtccgcccgcctggggcatgcagttcgtgcagcgctacttcgacaattcgccgagcgtcggcgatgatcttttccgccggatcgagcgcgcggccgccaaggcgaagatcgaagtggtcctcggtctcagcgagcgcgctgccggctcgctgtacctcgcgcaggcgttcatctcctcaacgggcgagacgcgcgcagtgcgccgcaagttgcgaccaacgcacgtcgagcgaaccgttttcggcgagggcgatggcagcgacttcaaggtgttcgacactccgctgggccgcgtcggtggtctcttgtgctgggaacacctgcaaccgctgtcgcgctacgcgatgttctcgatgaacgagcaggtgcacgccgccgcctggccgacgttcagcctctacacggattttgcccatgccctcggccacgaactgaatctcgcagccagcgctacttacgcggctgaagggcagtgctacgtgattgccgcctgtggcgtggtcacgcaggagatgctggatctgatgaaggcgccgtgccccccggaatatctgcgggtcggcggcggatacgccatgatctttgcgcccgacggacggcgcattgcggcggcgctgccgccggaacaagaagggctgatttacgccgacatcgatctttcgatgatctctctcgccaaggcggctgccgatcccaccggtcactactcgcggccggatgtcgtgcggcttatgctgaataccgaaccgatgcagcgggtcgaaaagctgcagccgccgctggactcagccgcgcgccgtgagaatgaaccggcacgcgagaccgcagcggcgaccgagagccgccagccccagtaa

SEQ ID NO: 268 - protein, 344 aa, Unknown
  Obtained from an environmental sample
MGITHPKFKAAAVQAAPGFLDSEATVDKTIRLMQEAADHGASLIVFPEAWLPGYPWWIWLGPPAWGMQFVQRYFDNSPSVGDDLFRRIERAAAKAKIEVVLGLSERAAGSLYLAQAFISSTGETRAVRRKLRPTHVERTVFGEGDGSDFKVFDTPLGRVGGLLCWEHLQPLSRYAMFSMNEQVHAAAWPTFSLYTDFAHALGHELNLAASATYAAEGQCYVIAACGVVTQEMLDLMKAPCPPEYLRVGGGYAMIFAPDGRRIAAALPPEQEGLIYADIDLSMISLAKAAADPTGHYSRPDVVRLMLNTEPMQRVEKLQPPLDSAARRENEPARETAAATESRQP

SEQ ID NO: 269 - DNA, 1014 bp, Unknown
  Obtained from an environmental sample
atgtctgaaacagccttcaagatcgcggtcgtacaggcggctccggtttttctcgacgcaaaggcgacggtggacaaggcgatcggtctgatggccgaagccggcgccaagggcgccaagctgctcgcattcccggaagtattcatccccggctacccttggtggctgtggctgggcacaccggcatggggcatgcagtttgttgccaagtatcacgcgaactcgcttcgtgcagacgggcctgaattggcagccctcgcggcggcggcggcgaagtccgatatcaatgccgtcatcggcttctcggagatcgacggcggttccctctacatcagccaggcgctcatcagcgacaagggcgagataatgttcaaacggcgcaagctgaagccgacgcacgtcgaacgcacgttgttcggcgaaggggacgggtccgacttccaggtcgtggacacgagcgtcggcaggctcggtgccttgtgttgcgccgaacacatacagccgctgtcgaagtacgcgatgtactccatgcacgaacaggtgcacgtcgcctcctggccgtcatttactttgtaccgcggcacggcatatgccttgggccacgaggtcaatctggccgcgagccagatttatgcgctcgagggaggctgtttcgtccttcatgcgagcgccatcaccggccaggacatgtttgacgtgctgtgcgacactccggagaggacgcaactgctgaactccgacggcggcaaggtcggcggcggctactcgatgatcttcggtcccgatggccagccccttgttgggcatctgcctcaagacaccgagggaatactctacgcagatattgacctggcgaacatttccgttgccaaagcggcctacgacccgtccggacactatgcgcgcggagacgtggtgcgcttgatggtcaatcgcaacccgcggcatacgagtgttgcgttcggcgggggcgccggcgaggcagcaacctggacggaagcaaaagcggagtga

SEQ ID NO: 270 - protein, 337 aa, Unknown
  Obtained from an environmental sample
MSETAFKIAVVQAAPVFLDAKATVDKAIGLMAEAGAKGAKLLAFPEVFIPGYPWWLWLGTPAWGMQFVAKYHANSLRADGPELAALAAAAAKSDINAVIGFSEIDGGSLYISQALISDKGEIMFKRRKLKPTHVERTLFGEGDGSDFQVVDTSVGRLGALCCAEHIQPLSKYAMYSMHEQVHVASWPSFTLYRGTAYALGHEVNLAASQIYALEGGCFVLHASAITGQDMFDVLCDTPERTQLLNSDGGKVGGGYSMIFGPDGQPLVGHLPQDTEGILYADIDLANISVAKAAYDPSGHYARGDVVRLMVNRNPRHTSVAFGGGAGEAATWTEAKAE

SEQ ID NO: 271 - DNA, 966 bp, Unknown
  Obtained from an environmental sample
atgtccagcgagaataacaacgctacattcaaagttgccgcagttcaggccacacctgtgtatcttgatcgtgaagcaaccatcgacaaggcttgcgagttgatcgctactgctggcagcgaaggagctcgcctgattatctttccagaagcgttcatcccaacctatcctgagtgggtatggggtattccttctggtgagcaaggtttactcaacgagctctattcagagttgctcaccaattcggtcacgattcccagcgacgcgactgacagactgtgcgaggccgcgaagcttgctaatgcctacgtggtgatgggaatgagtgaacggaatgtcgaagcgagtggtgcaagcctgtataatacgctcttgtacatagatgcgcagggggagattttagggaaacatcgaaagttggtaccaacgggcggtgagcgcctggtatgggcgcaaggtgatggcagcacgctgcaggtctacgatactccattgggaaaactcggtggtttaatttgctgggaaaattatatgccactggcacgctacgctatgtatgcctggggtacacaaatctatgtcgcagcaacgtgggatcgcggccaaccctggctctcaacgttacggcatattgccaaagaaggcagggtatacgtaattggttgctgtattgcgatgcgtaaagatgatattccagatcgttactccatgaagcagaagtattacgctgaaatggaggaatggattaatattggtgacagcgcgattgtcaatcccgaaggacactttattgcagggcctgtgcgcaagcaagaagaaattctttacgcggagatcgatccacgcatggtgcaaggcccgaagtggatgctcgatgtggctgggcactatgcgagaccagatgtgttccagttgacggtgcatacggatgtgaggcagatgattcgggtggaacatgattcataa

SEQ ID NO: 272 - protein, 321 aa, Unknown
  Obtained from an environmental sample
MSSENNNATFKVAAVQATPVYLDREATIDKACELIATAGSEGARLIIFPEAFIPTYPEWVWGIPSGEQGLLNELYSELLTNSVTIPSDATDRLCEAAKLANAYVVMGMSERNVEASGASLYNTLLYIDAQGEILGKHRKLVPTGGERLVWAQGDGSTLQVYDTPLGKLGGLICWENYMPLARYAMYAWGTQIYVAATWDRGQPWLSTLRHIAKEGRVYVIGCCIAMRKDDIPDRYSMKQKYYAEMEEWINIGDSAIVNPEGHFIAGPVRKQEEILYAEIDPRMVQGPKWMLDVAGHYARPDVFQLTVHTDVRQMIRVEHDS

SEQ ID NO: 273 - DNA, 1023 bp, Unknown
  Obtained from an environmental sample
atgaataactcaccaccaaccatccgcgctgctgccattcagctcagtccagttctgtttagtcgggatgggactaccgagaaggtgttgcaggcgatcgctagtgctgccaaggaaggggcacaactggttgtttttccagaaactttcatcccctactacccctatttctcattcattcaaccccctgtgttgatgggcaaagagcacatgcggctctatgaggaagccgtgacggtcccgggtccggtgacagatgcggtcagtcgagcagcccgttcttacggcatggtggtagtgctgggggtgaatgagcgagatggtggctcaatttacaatacacagttgattttcgatgctgacggcacattgttgctgaagcgacgcaaaatcacccctacctatcatgagcgcatggtctgggggcagggagacggtgctggattgaaggtattggatacagcagtcggtaaggtgggtgcgctggcatgttgggaacattacaatcccctggcacgatttgcgctgatggcacagcatgagcagattcactgcgctcagttccccggttctctggtgggacaaattttcactgatcagattgaggtaacgattcggcatcatgcgttggaatcgggttgttttgtggtgaatgctactggctggctctctccagaacaggtggcacaaatcaccacggatgaaaagttgcaacgggtgctgagtggcgggtgtaataccgccattattggacctgaaggcaatcatctctgtcctcccattaccgatggtgagggcatagcgatcgccgatctcgacttctcactaatcaccaaacgcaaacgcatgatggattgcgtcggtcactactcccgccctgacttgttgaagctgcaactcaatgcaacggcatggtcggtgctggctggggagcagggggcaggtgccagggagcaggggctaggtgtgccggatgccatgctgtctacgcctaagccagaatactcaacactggatcagtag

SEQ ID NO: 274 - protein, 340 aa, Unknown
  Obtained from an environmental sample
MNNSPPTIRAAAIQLSPVLFSRDGTTEKVLQAIASAAKEGAQLVVFPETFIPYYPYFSFIQPPVLMGKEHMRLYEEAVTVPGPVTDAVSRAARSYGMVVVLGVNERDGGSIYNTQLIFDADGTLLLKRRKITPTYHERMVWGQGDGAGLKVLDTAVGKVGALACWEHYNPLARFALMAQHEQIHCAQFPGSLVGQIFTDQIEVTIRHHALESGCFVVNATGWLSPEQVAQITTDEKLQRVLSGGCNTAIIGPEGNHLCPPITDGEGIAIADLDFSLITKRKRMMDCVGHYSRPDLLKLQLNATAWSVLAGEQGAGAREQGLGVPDAMLSTPKPEYSTLDQ

SEQ ID NO: 275 - DNA, 849 bp, Unknown
  Obtained from an environmental sample
atggagacggctcacaaagcaaaggtcgatttccttgtgctgggtgagacgtggctctcaggctacccggcttggctggaccactgccccgatgttggccggtgggattatgaaccgatgaaaaaagtgtatttgagatttcgacaaagtgctatttctgttcctggcaaagaatttgatttccttactggcctctgtaaaaaatattcacaaacgcttgccatcggtgttaatgagaaagtagatcatggggtaggtaatggtaccatttataattcatttctactgattgattctgatggaacactgttgaatcatcatcgcaagttagttcccacttttactgagaaattattatacggccatggagatggccatgggctgaagtcgatggatacttcggtgggaagaatcggagggagcatttgttgggaacattggatgccactatgcagacaagcacttcatgatgcaggtgagcaaatccatgttgccctttggccgactgttcatgacatccatcaagtggcaagtagaagctatgcatttgaagggcgctgctttgtattggctgccgggcagatttttgctgctaaagattttccaaaggaacttgtcttaccagactatctaaagcaaaatccggatcagctcattttgaatggggggagctgcgtgatcggccctgatgggaaatatttgattgagcccgtgtttgatcgggaagaactgattgtgtgtgaacttgaccttgacgaagcttataaagaaagaatgacgatggacgtttcaggtcactaccaaagacgagacgttttcagttttgacgtgaaccaacatcgacattga

SEQ ID NO: 276 - protein, 310 aa, Unknown
  Obtained from an environmental sample
MTKLKIAIGQFSSNHLDLKCSLEKLEKIMETAHKAKVDFLVLGETWLSGYPAWLDHCPDVGRWDYEPMKKVYLRFRQSAISVPGKEFDFLTGLCKKYSQTLAIGVNEKVDHGVGNGTIYNSFLLIDSDGTLLNHHRKLVPTFTEKLLYGHGDGHGLKSMDTSVGRIGGSICWEHWMPLCRQALHDAGEQIHVALWPTVHDIHQVASRSYAFEGRCFVLAAGQIFAAKDFPKELVLPDYLKQNPDQLILNGGSCVIGPDGKYLIEPVFDREELIVCELDLDEAYKERMTMDVSGHYQRRDVFSFDVNQHRH

SEQ ID NO: 277 - DNA, 1056 bp, Unknown
  Obtained from an environmental sample
atgccaacccccagcgatcatttcaaaatcgccgctgttcaggcctcgcccgtgtttctggaccgggaggccactgtggaaaaggcctgccggttgatcgccgaagccgcaaagcagggcgcccgcctcatcgtctttccggaatctttcatcccgacctacccggactgggtatgggccgttcccccgggaagggaaagaatcctgaaccagctgtattctgaattcctggccaatgccgtcgatgttcccggcgcggcgaccgaacaacttgcccaggctgcacgaatggccggcgcctatgtgattatgggcgtcaccgaaagagacacctcggccagcggggccagcctctacaacaccctgctctacttcagccccgaaggcatcctaatgggcaaacaccggaagctggttcccacggggggcgaacggctggtctgggcctacggagacggcagcacgctggaggtctacgacactccgctgggaaagatcggcgggctgatctgctgggagaactacatgcccctggcccggtacacgatgtacgcctggggcacccagatttacatcgccgccacctgggaccgcggggaaccgtggctctccaccctgcggcatatcgccaaggaaggaagggtctacgtcatcgggtgctgcatcgccctgcgccagggggatatcccggaccggttcgagtacaagggaaaattttattccgggtcccgggagtggatcaatgagggcgacagcgccatcgtgaacccggacggggaattcatcgccgggccggtgcggatgaaggaggagatcctgtatgccgagatagacccccggcagatgcggggccccaagtggatgctcgatgtggccggtcattacgcccggccggatatcttcgagctcatcgtccaccggaatccccacccgatgatcaaaatcgccgaagacaggggcgcggggatcgcctcaagtttgattcgcccccgccctaaccttcccccatcaagggggaggaaatcggcaagaagcaaacgcaagcccaaaaaatga

SEQ ID NO: 278 - protein, 351 aa, Unknown
  Obtained from an environmental sample
MPTPSDHFKIAAVQASPVFLDREATVEKACRLIAEAAKQGARLIVFPESFIPTYPDWVWAVPPGRERILNQLYSEFLANAVDVPGAATEQLAQAARMAGAYVIMGVTERDTSASGASLYNTLLYFSPEGILMGKHRKLVPTGGERLVWAYGDGSTLEVYDTPLGKIGGLICWENYMPLARYTMYAWGTQIYIAATWDRGEPWLSTLRHIAKEGRVYVIGCCIALRQGDIPDRFEYKGKFYSGSREWINEGDSAIVNPDGEFIAGPVRMKEEILYAEIDPRQMRGPKWMLDVAGHYARPDIFELIVHRNPHPMIKIAEDRGAGIASSLIRPRPNLPPSRGRKSARSKRKPKK

SEQ ID NO: 279 - DNA, 1014 bp, Unknown
  Obtained from an environmental sample
atgggcattacccatcccaaatacaaagtcgctgcagtccaggccgcgccggtctggctggacctggatgccacggtggacaagtgcatccgcctgatccaggaggccgctgacaagggctgcaagctgatcgcgtttccggagacgttcattcccggctatccctggcacatctggatgggtgcgccggcctgggccatcggccggggctttgtgcagcggtatttcgacaactccctgtcctatgacagcccgcaggccgaaaagctgcgccaggccgtcaaggccgcaggcatcaccgcgtcgctgggactgtcggagcgctcgggcggcagtctctacatcgcgcagtggctcattggccccgacggcgaaacgatctcgcagcggcgtaagctgcggcccacgcattccgaacgcaccgtcttcggcgacggcgatgggagcgacctcaaggtgcacgacacgccgctgggccgtgtgggtgagctggcgtgctgggagaacatcctgtcgctgaacaagtacgccatgttctcgcagcacgagcaggtgcacattgcagcctggcctagcttctccacctacgagccctttgcacatgccctgggctgggaagtgaacaacgcagtcagcaaggtgtacgcagtggaaggcgggtgtttcgtggtggcaccctgcgccatcatttccaaggagatggtcgatgaactgtgcgacaccccggacaagcacaccctgacccatgtgggaggcggccacgcggtgatctacgggccggatggcgcccccctggcggacaagctgcctgaagacgccgagggcctgctgatcgcggagatcgacctcgggatgattggcgtggccaagaacgccatggacccggtagggcactactcgcgccccgacgtgcaccgcctgcttctcaaccgcaagaaggcagcgcaggtggagcactttgcgctgccggtggacgccatcgattccgagccccaagccaccacggcgcactga

SEQ ID NO: 280 - protein, 337 aa, Unknown
  Obtained from an environmental sample
MGITHPKYKVAAVQAAPVWLDLDATVDKCIRLIQEAADKGCKLIAFPETFIPGYPWHIWMGAPAWAIGRGFVQRYFDNSLSYDSPQAEKLRQAVKAAGITASLGLSERSGGSLYIAQWLIGPDGETISQRRKLRPTHSERTVFGDGDGSDLKVHDTPLGRVGELACWENILSLNKYAMFSQHEQVHIAAWPSFSTYEPFAHALGWEVNNAVSKVYAVEGGCFVVAPCAIISKEMVDELCDTPDKHTLTHVGGGHAVIYGPDGAPLADKLPEDAEGLLIAEIDLGMIGVAKNAMDPVGHYSRPDVHRLLLNRKKAAQVEHFALPVDAIDSEPQATTAH

SEQ ID NO: 281 - DNA, 936 bp, Unknown
  Obtained from an environmental sample
atgtccaagatcgccgtcgtccaagagcctccggtgctgctcgatcgcgccgccaccctcgagcgcgccgtctcggccatcgagcgggcggccgacgtgggggcgcacctcgtcgtgttccccgagacgtacgtcccggggtaccccgactgggtctggcggacgcgccccgacgacttcaagctcgcgggcgcgctgcacgagcgcctcctcgcgaacgcggtcgacctcgaaaaggaccagctcgcgccgctccgcgaggccgcgcgccggcgaggcgtcaccatcgcgtgcggcgtgaacgagcgcgaggggagccacggccgcgcgaccctctacaacaccgtcgtcgtcgtcggacccgacggcgcgatcctcaaccgccaccgcaagctcgtccccacgaaccccgagcgcatggtctggggcccgggtgacgcgagcgggctgcgcgtcgtcgacacgccggccggccgcgtgggggcgctcatctgctgggagaactacatgccgctcgcgcgcttcgcgctctacgcgcagggcgtcgaggtctacctcgcgccgacgtgggatcacggcgacacttggctcgcctccatgcggcacatcgcgcgcgaggcgcgcgcctgggtcgtctcgggggccatctgcatgcaggcgaaggacgtccccgccgacttcccgcagcgcgcggcgatctaccccgacgaggaggagtggctcaaccccggcgatgccgtcgtcgtcgatcccaccggcgccgtcgccgccggcccgctgcaccgcgagcgcggcatcctctacgccgagtgcgatcccgcgcgggcgtcgctcgcccgccgcacgctcgacgtctccgggcactacggacggcccgacgtctttcacctgcagatcgaccgcacaccgcgcgtgccggcgtcgttccgggactga

SEQ ID NO: 282 - protein, 311 aa, Unknown
  Obtained from an environmental sample
MSKIAVVQEPPVLLDRAATLERAVSAIERAADVGAHLVVFPETYVPGYPDWVWRTRPDDFKLAGALHERLLANAVDLEKDQLAPLREAARRRGVTIACGVNEREGSHGRATLYNTVVVVGPDGAILNRHRKLVPTNPERMVWGPGDASGLRVVDTPAGRVGALICWENYMPLARFALYAQGVEVYLAPTWDHGDTWLASMRHIAREARAWVVSGAICMQAKDVPADFPQRAAIYPDEEEWLNPGDAVVVDPTGAVAAGPLHRERGILYAECDPARASLARRTLDVSGHYGRPDVFHLQIDRTPRVPASFRD

SEQ ID NO: 283 - DNA, 1017 bp, Unknown
  Obtained from an environmental sample
atgggcatcgaacatccgaagtacaaggtcgcggtggtgcaggcggcaccggcctggctcgatctcgacgcgtcgatcgacaagaccatcgggctgatcgaggaggccgcccaaaaaggcgccaagctgattgcattccccgaggccttcatccccggttacccctggcacatctggatggactcgccggcctgggcgatcggccgcggtttcgtgcagcgctattttgacaattcgctcgcctatgacagcccgcaggccgagaaactgcgcgcggcggttcgcaaggcaaagctcacggccgtgatcgggctgtccgagcgcgacggcggcagtctttacctcgcgcaatggctgatcgggcccgacggtgagaccatcgccaagcgccgcaagctgcggccgacacatgcggagcgcacggtatacggcgagggcgacggcagcgacctcgcggttcacaaccgtccggacattggccgccttggcgcgctctgctgctgggagcatctccagccgctgtcgaaatacgcgatgtacgcgcagaacgagcaggtgcatgtcgcggcctggccgagcttttcgctgtacgatcccttcgcggtggcgctcggcgccgaagtgaacaacgcggcctcgcgcgtctatgcggtcgaaggctcctgcttcgtgctggcgccgtgcgcgacggtctcgcaggccatgatcgacgaactctgcgaccggccggacaagcacgcgctgttgcatgtcggcggcggttttgccgcgatctacggtcctgacggcagccagatcggcgacaaactcgctcccgaccaggaagggttgctgatcgcggagatcgatctcggcgccatcggcgtcgccaagaatgcggcggatcccgccgggcattattcgcggcctgacgtgacgcgactgttgctcaacaagaagccgtacaagcgcgtcgagcagttttcgccgccggccgaggcgctcgagccgacggatatcgcagcagcagcaagctaa

SEQ ID NO: 284 - protein, 338 aa, Unknown
  Obtained from an environmental sample
MGIEHPKYKVAVVQAAPAWLDLDASIDKTIGLIEEAAQKGAKLIAFPEAFIPGYPWHIWMDSPAWAIGRGFVQRYFDNSLAYDSPQAEKLRAAVRKAKLTAVIGLSERDGGSLYLAQWLIGPDGETIAKRRKLRPTHAERTVYGEGDGSDLAVHNRPDIGRLGALCCWEHLQPLSKYAMYAQNEQVHVAAWPSFSLYDPFAVALGAEVNNAASRVYAVEGSCFVLAPCATVSQAMIDELCDRPDKHALLHVGGGFAAIYGPDGSQIGDKLAPDQEGLLIAEIDLGAIGVAKNAADPAGHYSRPDVTRLLLNKKPYKRVEQFSPPAEALEPTDIAAAAS

SEQ ID NO: 285 - DNA, 918 bp, Unknown
  Obtained from an environmental sample
atgaatactaatctagtaaaggtcgcggcggctcaagttgctccccattttctcaatttgagcaatacggtggaaaaaacctgcaacttaatttctgaagcaggcaaaaatggagcaaagctaatcgtatttccagaagccttcatctctggttatcccgattgggtctggcttattcccaatgcgaattctgcaatgctggatgatttataccaggaattggttgagaacgcagtaacgatccctgatacaacaacacataaactatgtcaggctgcaaaagatgcaggggtatatgttgcggtaggtatacatgagagaaattcagaagcaagtggcttcacgcttttcaatacgcttctatacatcaacgatcaaggcgtaatcatcggaaaacaccgaaaattaatccctacagggggcgaacggctggtctgggggcagggtaatggggatacactttctgcattcgatacagacttcggcaaattaggaggattgctttgttgggaaaattatatgccactcgcgcgtcaagctatgtattccgttggaactgaagtatatgtagccccaacctgggactccagcgagaattggttgttaagcatgcgccatattgcccgagagggcggtatgtttgtaattagtgtttgccaggctctccgaaaagacgacatccctgatcagtatgaatttaagaaactctatcctgataattcagaatggatcaatagcggtaacagttgcatcatcaacccgcgcggtgagattattgctggaccaatctcaaaccaacaagaaatactttatgcagatttagacctgagtttaattgcaaaatctaaacgtatgttcgatgttactgggcattattcccggccggatgtgtttagctatgaaatcaacaaaagctag

SEQ ID NO: 286 - protein, 305 aa, Unknown
  Obtained from an environmental sample
MNTNLVKVAAAQVAPHFLNLSNTVEKTCNLISEAGKNGAKLIVFPEAFISGYPDWVWLIPNANSAMLDDLYQELVENAVTIPDTTTHKLCQAAKDAGVYVAVGIHERNSEASGFTLFNTLLYINDQGVIIGKHRKLIPTGGERLVWGQGNGDTLSAFDTDFGKLGGLLCWENYMPLARQAMYSVGTEVYVAPTWDSSENWLLSMRHIAREGGMFVISVCQALRKDDIPDQYEFKKLYPDNSEWINSGNSCIINPRGEIIAGPISNQQEILYADLDLSLIAKSKRMFDVTGHYSRPDVFSYEINKS

SEQ ID NO: 287 - DNA, 936 bp, Unknown
  Obtained from an environmental sample
gtgatcaaggtagcaatcgcccaggtggcaccggtggttctggacaaggcgcgcaccattgagaaagcggtaggaattattcgcgctgccgcgcaagagggcattgagctcctggttttcccggagacgtttatcccgacctatccagcctgggtatggcgcttgcgtccgggtactgattacggcctgagcgaggaactgcacgcgctcctgctggataattcggtagatatggagagcaaggacctggagccattgcaagctgttgctgcagagaccagcatgaccgtggtaataggtatgaacgagcgagacggccgattcagccggggtacaatctacaatgccctggttgtgatcggtccaggtggcacgatcctgaacaggcaccgcaagcttatgcccaccaaccccgagcgtatggtttggggtatgggcgatgccagcgggctgaaggtagtggaaatgtcttacgggcgcctgggtgggctgatttgctgggagaatttcatgcctctcgcgcgctatggcttgtatgcccagggtgtggagatttacgtggcgcccacctatgaccagggcgacggctgggtcggcagcatgcagcatatagcccgggagggtcgttgctgggtactctcggccgggacccttttgcgtggcagtgattttctgccggattttccgggcaagaccgagttatatcccgatgaccaggagtgggtgaatccgggtggctcggtgatcgtggcaccggggggagagattgtggccggccccatgtatcgcgacgaaggtctgctggtctgcgagttggatgcgacgcttagtgtccgcggcaagcgctcgctggatgtggccggccattactcccggccggatttgtttgaactggaaatagatggcgacccgctggaacccatagagtgggattga

SEQ ID NO: 288 - protein, 311 aa, Unknown
  Obtained from an environmental sample
VIKVAIAQVAPVVLDKARTIEKAVGIIRAAAQEGIELLVFPETFIPTYPAWVWRLRPGTDYGLSEELHALLLDNSVDMESKDLEPLQAVAAETSMTVVIGMNERDGRFSRGTIYNALVVIGPGGTILNRHRKLMPTNPERMVWGMGDASGLKVVEMSYGRLGGLICWENFMPLARYGLYAQGVEIYVAPTYDQGDGWVGSMQHIAREGRCWVLSAGTLLRGSDFLPDFPGKTELYPDDQEWVNPGGSVIVAPGGEIVAGPMYRDEGLLVCELDATLSVRGKRSLDVAGHYSRPDLFELEIDGDPLEPIEWD

SEQ ID NO: 289 - DNA, 921 bp, Unknown
  Obtained from an environmental sample
atggtgacggtggccgccgtacaggcaacgccggtgttcctcgaccgcgaggcgacctcggacaaggtctgcgccttggtcaaggaggcggccggccacggggcagaactgatcgtcttccccgagtccttcgtccctgcctatccggactgggtgtggcgcacccctgcctggagtgacaccgagttcgtgaagcgcttctacgcgaacgcggtgaccgtccccggcgcgaccctcgagcgcatcggcgcagcggcggcggaggcggaggcgtacgtcgtgatcggcgtgaccgagatcgacggcggaactctctacaacacccttctctacctgggcccggacggacagctgttgcaacggcatcgcaagctcatgcccaccggtggggagcggaccgtgtggggaatgggagacggctctgagctcgacgtcgtgagcacgccgttcggcgtcgtcggtgggttgttgtgctgggagaactacatgccgctcgcccgggcggcgatctacgcccagcactgtgacatctacctggctccgacatgggacaacagcgacacgtgggtagccacgttgcgtcacatcgccaaggaggggcggcagttcgtcatcggcgtcgccccgctgctgcgcggctccgacgtaccggaggacctccgcggcacgctctacgggctgtcggacgactggatgtcgcgcggctacaccaccatcgtcgcaccaagcggcgaggtgatcgccggcccggtcctggagcgtgaggagatcctcttcgcggacctcgacctggccgacgtgcaggagcagagaaggatgttcgaccctgtcggccactactcacgacccgacgtcttcacgctccacgtcgacgcacgaccgaagagcccggtcgtcttcgagagggatgcaccgacctga

SEQ ID NO: 290 - protein, 306 aa, Unknown
  Obtained from an environmental sample
MVTVAAVQATPVFLDREATSDKVCALVKEAAGHGAELIVFPESFVPAYPDWVWRTPAWSDTEFVKRFYANAVTVPGATLERIGAAAAEAEAYVVIGVTEIDGGTLYNTLLYLGPDGQLLQRHRKLMPTGGERTVWGMGDGSELDVVSTPFGVVGGLLCWENYMPLARAAIYAQHCDIYLAPTWDNSDTWVATLRHIAKEGRQFVIGVAPLLRGSDVPEDLRGTLYGLSDDWMSRGYTTIVAPSGEVIAGPVLEREEILFADLDLADVQEQRRMFDPVGHYSRPDVFTLHVDARPKSPVVFERDAPT

SEQ ID NO: 291 - DNA, 1002 bp, Unknown
  Obtained from an environmental sample
atgatgaaaacaactgttaccgttgcctgcgttcaggccgcccccgtatttatggatttagaaggcaccatagataaaacgatcaccctcatctctgaagccgcacagaaaggcgcggagctcatcgcttttccggagacctggatacccggttacccgtggttcttatggctgaactcgcccgcgacaaatatgcccctggtttatcaatatcatcagaactctctggtgctggacagtgcccaggcgaagcgaattgcggatgctgcacagcagaataacatcactgtcgttctgggattcagcgagcgcgatcatggaagcctctatatctcacagtggctgattggcagcgacggggaaactattggcatccggcgcaagctcaaggccacacacgtggagcgtacgctgttcggcgaaagcgacggctcctccctgaccacctgggagacacctctgggtaacgtcggggccctctgctgctgggagcacctgcagccgctgtctcgctatgcgatgtattcccagcatgaagagatccatatcgctgcgtggcccagcttcagtctttacaccagcgcaactgccgcgctcggacctgacgtcaacacggcggcttcacgcctctatgccgcggaggggcagtgcttcgtgttagccccatgtgccgtggtttctgatgagatgattgatttactctgtcctgatgatgaccggagagcgttactcagtgccggagggggacatgcccgtatttacggacctgatggaagagaactcgtcacccctctcggggaaaatgaggaaggactgcttatcgctgagctcgactctgctgcgatcacctttgccaaactggcggcagatcccgtaggccactattcccgccctgacgtgacccgccttctttttaatccttcagccaacaagactgttattaaacggcattcgcctcctgagttaattgccgaacaggctccggaagaagaggaggagtag

SEQ ID NO: 292 - protein, 333 aa, Unknown
  Obtained from an environmental sample
MMKTTVTVACVQAAPVFMDLEGTIDKTITLISEAAQKGAELIAFPETWIPGYPWFLWLNSPATNMPLVYQYHQNSLVLDSAQAKRIADAAQQNNITVVLGFSERDHGSLYISQWLIGSDGETIGIRRKLKATHVERTLFGESDGSSLTTWETPLGNVGALCCWEHLQPLSRYAMYSQHEEIHIAAWPSFSLYTSATAALGPDVNTAASRLYAAEGQCFVLAPCAVVSDEMIDLLCPDDDRRALLSAGGGHARIYGPDGRELVTPLGENEEGLLIAELDSAAITFAKLAADPVGHYSRPDVTRLLFNPSANKTVIKRHSPPELIAEQAPEEEEE

SEQ ID NO: 293 - DNA, 1008 bp, Unknown; identical to SEQ ID NO: 39
  Obtained from an environmental sample

SEQ ID NO: 294 - protein, 335 aa, Unknown; identical to SEQ ID NO: 40
  Obtained from an environmental sample

SEQ ID NO: 295 - DNA, 1134 bp, Unknown
  Obtained from an environmental sample
atggccgcaaaagtacttggaggacgtgacacagtaaaagtagcagttgttcaaacaccatcagtctttatggacaagaaagcctgtctcgaacttgcctgcgataagattatcgaagccggcaaagagggcgcggagcttgttgtttttcctgaaacctggattccgacatatccttattggaccatgggatgggataccatcgcccatggcttccatgatgtgatggcggacctgcaggacaattccgtggtcgtcgggagcgaagacaccgacatattgggcaaagccgcccgggaagctggcgcctacgtcgtcatgggctgtaatgagctcgatgaccgggtcggcagcaggaccttgttcaactcgctggtctatatggacaaatatggcggcgtgctcggccgtcaccgtaaattaatcccgtcctttatcgaacgcatctggtggggcaatggggacagccgcgatctcaaagtttacgacacggaaattgggcgcatcggcggtcaaatctgctgggaaaatcacattgtgaacatcaccgcatggtacattgcccaaggcgtggatattcatgtctcggtttggccgggaatgtggaactgtggcgcagaagaaggagaatccttcatatacgccggtcacgacatcaacaaatgtgacctcatccctgctacacgcggacgggcatttacgggtcagtgttatgtcctctcagccaacaacctactgcggatggaagacattcctgacgatttcccgttccgggataccatgaactatggcggtccgggccaggaggattttgtcggatgggcttgcggtggcagccatattgttgcgccaacgtctgaatttatggtgccgccgacgtttgatatagacaccatcatctatgcagaacttcaggcgaaatacatcaaagtggtgaagtcggtcttcgattccctcggccactacgcgcggtgggacctcgtcaacttgaccacgccgccaccgccgtatgaacctgaaaccgacgcaccagctctcacggccgatatccgtgatcgggtcatcgagagtgtggctaaagagttcaagctcgaaccagaaaaagtggctgaagttgtgcgcaatgccgcctag

SEQ ID NO: 296 - protein, 377 aa, Unknown
  Obtained from an environmental sample
MAAKVLGGRDTVKVAVVQTPSVFMDKKACLELACDKIIEAGKEGAELVVFPETWIPTYPYWTMGWDTIAHGFHDVMADLQDNSVVVGSEDTDILGKAAREAGAYVVMGCNELDDRVGSRTLFNSLVYMDKYGGVLGRHRKLIPSFIERIWWGNGDSRDLKVYDTEIGRIGGQICWENHIVNITAWYIAQGVDIHVSVWPGMWNCGAEEGESFIYAGHDINKCDLIPATRGRAFTGQCYVLSANNLLRMEDIPDDFPFRDTMNYGGPGQEDFVGWACGGSHIVAPTSEFMVPPTFDIDTIIYAELQAKYIKVVKSVFDSLGHYARWDLVNLTTPPPPYEPETDAPALTADIRDRVIESVAKEFKLEPEKVAEVVRNAA

SEQ ID NO: 297 - DNA, 1059 bp, Unknown
  Obtained from an environmental sample
atgacacgttttcgggacgtcacggtggcggcggttcaggccgcacccgtctatttcgatcgggaggcctccacagataaggcgtgccaattgattcacgaagcggcgaagaaaggcgcagccctcgcggcgttcggcgaaacgtggttgccgggatatccgttctttgcatgggggttcgcgcacaaccggagcctgttctggaatgcggccgccgagtacatcgccaatgctgtggagattccgagtccaacgacggaccgcctctgcgccgcagcgaagatcgccgggattgacgtggtaatcggcgtcgtagaactggatggacgaacgcgagcgtcggtttacagcacactgctgttcatcgggagagagggggcgatcctggggcgccaccgcaaattgaagccaacccacatggagcgaacggtgtggggtgaaggggacgctcacgggctccgcgttcacgagcgtccgtacggccgcctcagcgggctgaattgctgggaacacaacatgatgctgcccggctatgtgcttgccgcgcagggcacgcagtttcacgtcgcgacatggcctgggaaagagaggctcacagttccgccgaacgaggcggcttatacgcgccagcttctcctctctcgcgcctatgcatcccaggcgggcgcgtacgtgatcagcgtcgcggggctgctcggacccgactcgatgccggagcgttatcgcgaactgggacagtcctatgagttgaccggcgacagcgtcatcatcgatccgcgcggcgaggtcatcgcggggcccgcgaagggcgagaccatcctgctcgcgcaatgcagccaggaagccctcttcgccgcaaagtccgccattgacgtcggcggtcattactcgcgcccggatatttttcagctgcgtgtcaacgatcagctacagcatcaggtccggagactcgaggcgactctcacgcccccagtcgccgtagttgtcgggcctgagggtagctcacatgagcaggagacggccttcgggccatccagcctcctggccacgacaagctag

SEQ ID NO: 298 - protein, 352 aa, Unknown
  Obtained from an environmental sample
MTRFRDVTVAAVQAAPVYFDREASTDKACQLIHEAAKKGAALAAFGETWLPGYPFFAWGFAHNRSLFWNAAAEYIANAVEIPSPTTDRLCAAAKIAGIDVVIGVVELDGRTRASVYSTLLFIGREGAILGRHRKLKPTHMERTVWGEGDAHGLRVHERPYGRLSGLNCWEHNMMLPGYVLAAQGTQFHVATWPGKERLTVPPNEAAYTRQLLLSRAYASQAGAYVISVAGLLGPDSMPERYRELGQSYELTGDSVIIDPRGEVIAGPAKGETILLAQCSQEALFAAKSAIDVGGHYSRPDIFQLRVNDQLQHQVRRLEATLTPPVAVVVGPEGSSHEQETAFGPSSLLATTS

SEQ ID NO: 299 - DNA, 987 bp, Unknown
  Obtained from an environmental sample
atgactgttgttaaggccgccgcagtgcagatcagcccggtgctctacagccgtgcaggaaccgtcgagaaggtcgtgaagaagatcgacgagctgggccagaagggtgtcgagtttgccgtcttccctgaaaccgttgtcccctactacccctacttctccttcgtgcagcccccctacaaactggccacggagcacctgcgcctgcttgaggagtcggtgaccgtgccctctgccgagacggacgccatcggcgacgccgcccgcaaggccaacatggtcgtctcgatcggtgtcaacgaacgtgatggcggcaccatttacaacacccaactcctgttcgacgccgacggaaccctgatccagcgccgccgcaagatcacgccgacctaccacgagcggatgatctggggacagggagacggatcaggcttgcgcgcggtcgacagcgtcgtcggccgcatcggccagctcgcctgctgggagcactaccagccgctggcccgttacgctctcatcgccgacggcgagcagatccacgccgcgatgtaccccggcgccttcgggggcgatctgttcgcagagcagatcgaagtcaatgtccgtcagcacgctctggaatcggccagtttcgtcgtcagcgccaccgcctggctcgacgccgaccagcaggcccagattgcgaaggacaccggcggccccgtacaggcgatctccggcggcttcttcacagccatcatcgaccccgacggccgcatcatcggcgaaccgatcacctccggcgaaggcgaagtcatcgctgacctcgactttgcgctcatcgaccgccgcaagcgcctgatggacgccagcggccactacagccgccccgaactgctcagcctgcagatcgaccggacgccggcacccgccgtccacgatcgcaatcgccaggggtcctcaagcgctccggcaactgaaaagggccgctcagccgaggccaagtga

SEQ ID NO: 300 - protein, 328 aa, Unknown
  Obtained from an environmental sample
MTVVKAAAVQISPVLYSRAGTVEKVVKKIDELGQKGVEFAVFPETVVPYYPYFSFVQPPYKLATEHLRLLEESVTVPSAETDAIGDAARKANMVVSIGVNERDGGTIYNTQLLFDADGTLIQRRRKITPTYHERMIWGQGDGSGLRAVDSVVGRIGQLACWEHYQPLARYALIADGEQIHAAMYPGAFGGDLFAEQIEVNVRQHALESASFVVSATAWLDADQQAQIAKDTGGPVQAISGGFFTAIIDPDGRIIGEPITSGEGEVIADLDFALIDRRKRLMDASGHYSRPELLSLQIDRTPAPAVHDRNRQGSSSAPATEKGRSAEAK

SEQ ID NO: 301 - DNA, 1032 bp, Unknown
  Obtained from an environmental sample
atgaccacgcccgcgccgttcaccgccgccgtcgtccaggcgtcgcccgtgttcctcgaccgcgatgccacggtcgataaggcgtgcgccctgatcaccgcggccggagcgcgcggcgcgaagctcgtcgtgctgcccgagaccttcgtgcccgcataccccgcgtgggtctggtacctgccgctcacgcgtcggcccgacgtcgcgaagctctaccgcgcgctcgtcgagaacgcgatcgacgtgccgggtccggaaaccgagcgcctcgggcgcgcggcgcgtgacgcgggcgcgtgggtggcgatcggtgtcaacgagcgcaacgcgaaggcgagccgcacgtcgctctacaacaccgtgctcctgttcgacgaccagggcacgctggtcgagtcgcggcgcaagctgatgccgaccggcggcgagcgcctggtgtggacgccgggcgagccggtgccgttgcgggttcacgacacgccgctcggccgcgtcggcgcgctgatctgctgggagaactacatgccgctcgcgcgcttcgcgctctacgagcagggcgtccagatctatctcgcgccgacctgggactacagcgaggcgtggctcgcgtccatgcggcacgtcgcgcgtgaaggtcgcacgtgggtgatcgggtgcagccaggcggtgcggcgtgacgagatcccggaccacctgccgttcaaggacgcgatccccgagagcctcgagtggatcaacgccgggaacagcatcgtcgtcgatccggacggcgcggtggtcgcgggaccgctggcgcgggcgcacgacacgctctacgtcgagatcgatccgggccgcgccgccggctcccgatggatcttcgacgccgccggtcactatcaccgtcccgacctgttccatttcgcgatgcgcgcgccggtggcgccagagaccgcgccggttgtgcggaagcgcggccggcggctagcctcggccccggcgcggaagccacggaaacggccggcgcgtcccacccgaaggaggactcgatga

SEQ ID NO: 302 - protein, 335 aa, Unknown
  Obtained from an environmental sample
MTTPAPFTAAVVQASPVFLDRDATVDKACALITAAGARGAKLVVLPETFVPAYPAWVWYLPLTRRPDVAKLYRALVENAIDVPGPETERLGRAARDAGAWVAIGVNERNAKASRTSLYNTVLLFDDQGTLVESRRKLMPTGGERLVWTPGEPVPLRVHDTPLGRVGALICWENYMPLARFALYEQGVQIYLAPTWDYSEAWLASMRHVAREGRTWVIGCSQAVRRDEIPDHLPFKDAIPESLEWINAGNSIVVDPDGAVVAGPLARAHDTLYVEIDPGRAAGSRWIFDAAGHYHRPDLFHFAMRAPVAPETAPVVRKRGRRLASAPARKPRKRPA

SEQ ID NO: 303 - DNA, 1011 bp, Unknown
  Obtained from an environmental sample
atgggcatcgttcaccccaagtacaaagtcgctgtcgttcaggctgcccctgtatggctagacctggaggccactgttgataaatgcattcagttgattgaagaagcagccagcaagggctgcaagctcatcgccttccctgagaccttcattcccggatacccttggtatatctggatgggaacgcctgcctggactattcagcgcggctttgtacagcgctattttgataattctctgtcttatgacagtccgcaagcggagaagctaaggcaggcagtcaaaaaggctgagatcacggccgtactaggtctttctgagcgcagcggcggtagcttgtacattgcacaatggaccattggccctgacggagaaaccatacacaaacgcagaaaagtgcgtccaacgcatggtgagcgtacggtatttggcgacggtgacggtagtgatcttgcggtgcacgatacccccctggggcggctgggcgcgcttgcgtgctgggagaacatactgtcactgaacaagtatgcgatgtattcacagaatgagcaggtgcacgtagccgcttggcctagcttctcggtctacgagcctttcgcccatgcattgggttgggaggtcaataacgcagtcagcaaggtttacgcggtagaaggcggctgttttgtattggcgccttgcgcagtggtctccgaggaaatgatcgaagcactgtgcgatacacccgataagcaccaactggctcatgcgggtggagggcatgctgtcatttacggaccagatggcagtcctctggcagataagttacccgaaggagaggaggggctattaattgcagaaattgatctcggtctcatcagcttggcgaaaaatgccatggacccggtggggcattactctcgacctgacgtacatcgcttgctattgaatcgcaatccagcaaagcgggttgaggaattttctctgcccattgatttggcagagacaactccgccaatattaggcacgtag

SEQ ID NO: 304 - protein, 336 aa, Unknown
  Obtained from an environmental sample
MGIVHPKYKVAVVQAAPVWLDLEATVDKCIQLIEEAASKGCKLIAFPETFIPGYPWYIWMGTPAWTIQRGFVQRYFDNSLSYDSPQAEKLRQAVKKAEITAVLGLSERSGGSLYIAQWTIGPDGETIHKRRKVRPTHGERTVFGDGDGSDLAVHDTPLGRLGALACWENILSLNKYAMYSQNEQVHVAAWPSFSVYEPFAHALGWEVNNAVSKVYAVEGGCFVLAPCAVVSEEMIEALCDTPDKHQLAHAGGGHAVIYGPDGSPLADKLPEGEEGLLIAEIDLGLISLAKNAMDPVGHYSRPDVHRLLLNRNPAKRVEEFSLPIDLAETTPPILGT

SEQ ID NO: 305 - DNA, 1068 bp, Unknown
  Obtained from an environmental sample
atgacgatgcaacatcccaagtttcgcgctgctgccgtgcaggcggcaccggtcttccttgaccttgatgcgtcgatagataaagccatcgacctgatcgcgcaagccgccaaaggcggcgcgcaattgattgcctttccggaaacctggctgcccggctacccctttttcatctggctcgattcgccggcctggggcatgcaattcatccagcgctaccatgacaattccctggtctacggcacaccgcaggccgagcgcatcgcgcaggctgcgaaaaagcatcgcatcatggtcgtcatggggcacagcgagcgggatcatggaagtctgtacatcgctcagtggatcatcggtgccgatggggaaacggttgcgacacgtcgtaagctcaaaccgactcatgccgagcgcaccttgtttggggaaggcgatggcagtgacctgagcgtgttcgatacaccgctgggaagggttggcgcactatgctgctgggagcacctccagcccctgtcgaaatacgcgctatacgcacagaatgagcaggtccacattgcttcctggccaagcttttccctgtatcgcgggggcgcctacgcgctcggcgccgaagtgaacaatgcggccagccagatttatgctgtcgaaggccagtgttttgtgatcgcgccgtgcggggtcgtcacgaaagaaatgctggacgtgctgtgcaccgacgaaatgaaaaagcagttgttggttgaaggcggcgggttcgcgcgaatttacgcgcccgatggacagatgatgcacgcgccgctggcggaaaacgaagagggcctggtgtatgccgatctcgacctgggcatgatctcgctggccaaagtagtcgccgacccggccgggcattatgcgcggcccgacgtaacccggttactgctggacaagactccgggagaccgcgtcatgctggcgagccgtcgcggcaaggaggtcagccgcgctggtaacgacgagccgcaagtgctggtctcgcgcaacgacacgctgacctcgccgaagccagcgtcttcgcgcaaagcaagctga

SEQ ID NO: 306 - protein, 355 aa, Unknown
  Obtained from an environmental sample
MTMQHPKFRAAAVQAAPVFLDLDASIDKAIDLIAQAAKGGAQLIAFPETWLPGYPFFIWLDSPAWGMQFIQRYHDNSLVYGTPQAERIAQAAKKHRIMVVMGHSERDHGSLYIAQWIIGADGETVATRRKLKPTHAERTLFGEGDGSDLSVFDTPLGRVGALCCWEHLQPLSKYALYAQNEQVHIASWPSFSLYRGGAYALGAEVNNAASQIYAVEGQCFVIAPCGVVTKEMLDVLCTDEMKKQLLVEGGGFARIYAPDGQMMHAPLAENEEGLVYADLDLGMISLAKVVADPAGHYARPDVTRLLLDKTPGDRVMLASRRGKEVSRAGNDEPQVLVSRNDTLTSPKPASSRKAS

SEQ ID NO: 307 - DNA, 942 bp, Unknown
  Obtained from an environmental sample
atggctgaaccggaatcctttatcgtcgctgctgtacaggctacaccgatctttcttgaccgccaggcaacccttgagaaagcgtgcgacctgattgccgaagctggcagcaatggcgcaaaactcgttctttttcccgaagcctttatccccacctatcctgattggatatgggcggtgacaggctcacaatctgcgctgctcgacgaactttatgtggaactactggaaaactccgtgaccatccccgacgcgaccactgagcaactttgtgaagcagcacgtaacgccggtctctacgtcgtcatgggagtgaatgagcgcaacgccgaggcgagcaacgccacactctataacaccctgctctatattgacgatcagggcaaaattctcggcaagcatcgcaaattggtcccgaccgccctggagcgaatcgtctggggctatggcgatggcagcacgcttgacgcctttgaaacgccgctgggcaagattggcgggctgatctgttgggaaaattacatgccactggcgcgccaaacactttatgcctggggggtgcaaatttacttggccgcaacgtgggatcgcggcgaagtttggcaggcgaccatgcgccatattgccagggaaggcggcgtctatgtagtcgcctcctgtattccatttcacatcaaagacattcctgaccacatgcctgaaatccgcaatctctatgcaccggggacagactggatcaacgtcggccaaagctgcatcatcaaccccagcggcgactatattgcaggccctgtcgagtgtcgcgaggagattctttatgccgaggtaaatctgcgccagagtgcggcggcaaaacgtatgttggatgtggcgggccattatggacgccctgatgtctttcacctcaccgtcaaccgcacgcccaatccgcatattcgataa

SEQ ID NO: 308 - protein, 313 aa, Unknown
  Obtained from an environmental sample
MAEPESFIVAAVQATPIFLDRQATLEKACDLIAEAGSNGAKLVLFPEAFIPTYPDWIWAVTGSQSALLDELYVELLENSVTIPDATTEQLCEAARNAGLYVVMGVNERNAEASNATLYNTLLYIDDQGKILGKHRKLVPTALERIVWGYGDGSTLDAFETPLGKIGGLICWENYMPLARQTLYAWGVQIYLAATWDRGEVWQATMRHIAREGGVYVVASCIPFHIKDIPDHMPEIRNLYAPGTDWINVGQSCIINPSGDYIAGPVECREEILYAEVNLRQSAAAKRMLDVAGHYGRPDVFHLTVNRTPNPHIR

SEQ ID NO: 309 - DNA, 951 bp, Unknown
  Obtained from an environmental sample
ttgaccgactgtctcaaaatagccgccgcccaaatcactccggtcttcctcgaccgcgttgcgaccacgaagaaggtcgtcgaaaccatcgaaaaagcggccgccggcggtgcgcggctggtcgcattcggcgaagcgctgttgcccgcctatccattgtggctgacgcgcaccgacgccgcgcggttcaattccgacgtgcaaaaaaacttgcacgcgatctatctcaagcaatccgtctcgatagcaggcggtcacctatctccgatttgcaaaatcgcaagcgaacgcaagattgccgtcatcctcggcatcgccgagcgcgcgaccgaccggggcgaccacaccatttactgctcgtgcgtgttcatcgatgccgacggccgaatcgcgtcggtccatcgcaagctgatgccgacatacgaagaacgcctcagttggggattcggcgacggtgcgggactcgtcacgcatccggtcgggccgttcacggtgggcgcgttgaactgctgggaaaactggatgcccctcgcgcgcaccgcgctgtatgccggcggagaagatttgcacgttgcgatctggcccggcggatcggtgctcacggaagacatcacgcgcttcatcgcacgcgagtcgcgctcgttcgtcctgtccgtcagcggcatcattcgcgaaagcgacatccccagcggggtcccctatcgcgatgaaatgtgtgcgaaaggcgaaaccatctacaacggcggaagctgcatcgccggacccgacggtcagtggatcatcgcgcccgtaaccgaccgtgaagagttgatcttcgcggagatcgaccacgaacacgtccgccgcgagcggcagaatttcgacccggccgggcattacgcgcggcccgatgtgttgcaaataaccgttgatcgtcgacgacaaacagcggcgaattttattgatgactaa

SEQ ID NO: 310 - protein, 316 aa, Unknown
  Obtained from an environmental sample
LTDCLKIAAAQITPVFLDRVATTKKVVETIEKAAAGGARLVAFGEALLPAYPLWLTRTDAARFNSDVQKNLHAIYLKQSVSIAGGHLSPICKIASERKIAVILGIAERATDRGDHTIYCSCVFIDADGRIASVHRKLMPTYEERLSWGFGDGAGLVTHPVGPFTVGALNCWENWMPLARTALYAGGEDLHVAIWPGGSVLTEDITRFIARESRSFVLSVSGIIRESDIPSGVPYRDEMCAKGETIYNGGSCIAGPDGQWIIAPVTDREELIFAEIDHEHVRRERQNFDPAGHYARPDVLQITVDRRRQTAANFIDD

SEQ ID NO: 311 - DNA, 1011 bp, Unknown
  Obtained from an environmental sample
atgtcagaaaagcgaataatcagagcagctgcagttcagatcacacctgaatttgactcagcagatggaacagttaagaaggtatgcaaggtaatcgatgaagcaggcgcaaagggtgtacaaattatagtattccccgaaaccttcattccgtattacccatacttctcattcattacccccccagtttctgctggcgctgagcatttgaagctttatgaaaaaagtgtcgtgatacctggtcctgtcactcaagcgatcgccgagagagctagagtgaatcaaatggtcgtcgtactcggtgtaaacgagagagataacggtagcctctataacactcaactgatcttcgataccaatggtgagttgatgttgaagagaagaaaaatcactcctacatatcatgagcgcatgatctggggacaaggtgatgcttcaggcttaaaagtagttgaaacgagcattgcccgggtaggtgctctagcttgctgggaacattacaacccgctggccagatattctctcatgacacagcatgaagaaattcactgcgcacaattcccaggttctatggttggccaaatatttgccgaccaaatggatgtcactatcagacatcacgcattggaatctggctgtttcgtcattaatgccaccggctggctcacagacgagcaaatccagtccattacagatgacccaaaaatgcagaaagcattacgtggcggctgcaacacagcaatcatttctcccgaaggtgtgcacttaacagagcccttacgtgaaggtgaaggcattttgattgctgacctggacatgtcactcatcacaaaacgaaaaagaatgatggattcagtaggtcattattcaagacctgaactattaagtctggcgatcaatgacaagccagcaacaacaaaattttcaatgactgaggggtgtactcaaactgagcaatttcgaatcgcagaggagttgaaaaatgacgacaagcttagcaccggaaactaa

SEQ ID NO: 312 - protein, 336 aa, Unknown
  Obtained from an environmental sample
MSEKRIIRAAAVQITPEFDSADGTVKKVCKVIDEAGAKGVQIIVFPETFIPYYPYFSFITPPVSAGAEHLKLYEKSVVIPGPVTQAIAERARVNQMVVVLGVNERDNGSLYNTQLIFDTNGELMLKRRKITPTYHERMIWGQGDASGLKVVETSIARVGALACWEHYNPLARYSLMTQHEEIHCAQFPGSMVGQIFADQMDVTIRHHALESGCFVINATGWLTDEQIQSITDDPKMQKALRGGCNTAIISPEGVHLTEPLREGEGILIADLDMSLITKRKRMMDSVGHYSRPELLSLAINDKPATTKFSMTEGCTQTEQFRIAEELKNDDKLSTGN

SEQ ID NO: 313 - DNA, 987 bp, Unknown
  Obtained from an environmental sample
atggcggccgttcaggctgcgccggttccgtttgatgctgaggcttcggtggataaggcctgtcgcttaattcaagaagctgcagccaaaggcgcagatatagttgctttcggtgaggcatggctacccggctacccctattttgcctggttaccccaagtaacaccagagtggtatagtgcggctgccgattatcttgccagctctgttgatatccctggcccgatcaccgataaactttgccaggctgcccgtcgtgcatcggttgaactcatcatgggtgtggtagaacgcagcaagtctcagggaaccacctattgcacgcttctttttattagcaaggatggcgaaataattggcaagcaccgcaagctgaagcccacactcgccgaacgaaccgtctggggtgaaggcgatgccagcggactgagggttcacgatcggcctattgccagaatcagtgggctctcctgctgggagaacaaaatgatgctgccaggttacgcactgatggcgcagggtacgcaggtgcatgtctccgcctggccagggatcccagaggattcacccatggaggtgcctgcacacccccgtcaaaagctgctttcccaagcctttgcactgcaaggcgggtgctatgttatttctccctccattgtccttagggcagaagatgtgcccgagaaacacgccgctctactgatgggagaccaagtgggcggtagctatatcattgacccctgcggaaaagtgatcgccgaggccggtgcgggtgagactatcctgattgccaaaggcaaccttgacctcgtaagggccgccaaaatggccagtgatgtaggggggtcttattcacgcccggatcttttgcagttgatgatcaataaccgaccactcgaacagctgattgagttcagtgctgaaggtgcaggtagggggaatctagtatccaactcacccgaggtgtcagaacaagaaggtgagtaa

SEQ ID NO: 314 - protein, 328 aa, Unknown
  Obtained from an environmental sample
MAAVQAAPVPFDAEASVDKACRLIQEAAAKGADIVAFGEAWLPGYPYFAWLPQVTPEWYSAAADYLASSVDIPGPITDKLCQAARRASVELIMGVVERSKSQGTTYCTLLFISKDGEIIGKHRKLKPTLAERTVWGEGDASGLRVHDRPIARISGLSCWENKMMLPGYALMAQGTQVHVSAWPGIPEDSPMEVPAHPRQKLLSQAFALQGGCYVISPSIVLRAEDVPEKHAALLMGDQVGGSYIIDPCGKVIAEAGAGETILIAKGNLDLVRAAKMASDVGGSYSRPDLLQLMINNRPLEQLIEFSAEGAGRGNLVSNSPEVSEQEGE

SEQ ID NO: 315 - DNA, 960 bp, Unknown
  Obtained from an environmental sample
atgacaatgcttaagaccaaattccgggttgctgcggtgcaggcagcgcctgtattcctggatcgagaggctacgctggagaaagcctgcggactgattgaggaggcgggtcgcaacggggccagcctggtggtctttcctgagtcgttcattccggcctatcccgattgggtctgggctgtgccggcgggtgaagaagctttacttaatgaactgtatgctcaactgctggccaacgccgttgaaattcccagcccggccaccgaacgcttgagccaggcagcgaaaaaggctaaagtccatgtggttatgggcctgaccgaacgcaacagcgaggccagcggcggcagcctctacaataccttgctctatcttgacccacagggccaaattctgggcaaacatcgcaagctggtgcccaccggcggcgagcggctggtttgggcccagggcgacggcagtaccctgcaagtctacgagacccccttgggtaaactcagcggcttgatttgctgggaaaattatatgccgctggcccgctacgcgctctatgcctggggtacgcaaatctatatcgccgccacctgggatcgaggcgagccgtggctttcgacgctgcggcatatcgccaaagagggccgggtgtttgtcatcggctgtggcatggccttgcgtaaggctgatattcccgaccattttgaattcaagcagcgcttttatcaaaatgccggcgagtggatcaatggaggcgacagcgccattgtcaatcctgagggtgaatttattgctggacccctgagcgagcaggaaggtattttgtacgccgagattgatcctggccagatggccggaccaaaatggatgctcgatgtggccgggcactatgctcgcccggatgtctttgaactgaccgtccagaccgtagctcggcccatgattacctctactcagccgcgatag

SEQ ID NO: 316 - protein, 319 aa, Unknown
  Obtained from an environmental sample
MTMLKTKFRVAAVQAAPVFLDREATLEKACGLIEEAGRNGASLVVFPESFIPAYPDWVWAVPAGEEALLNELYAQLLANAVEIPSPATERLSQAAKKAKVHVVMGLTERNSEASGGSLYNTLLYLDPQGQILGKHRKLVPTGGERLVWAQGDGSTLQVYETPLGKLSGLICWENYMPLARYALYAWGTQIYIAATWDRGEPWLSTLRHIAKEGRVFVIGCGMALRKADIPDHFEFKQRFYQNAGEWINGGDSAIVNPEGEFIAGPLSEQEGILYAEIDPGQMAGPKWMLDVAGHYARPDVFELTVQTVARPMITSTQPR

SEQ ID NO: 317 - DNA, 993 bp, Unknown
  Obtained from an environmental sample
atgaccattgtaaaagccgctgccgtccaaataagccctgtcctttacagccgcgaaggcaccgtggacaaggttgtccagaagatcctcgaactcggcaagcaaggcgtccagttcgccactttcccggagacggtggtcccctactacccctacttctccttcgtccagtcgggctacgccctcaaggtgggcaaggaacatctgcgcttgctcgaacagtcggtcaccgtgccatcggccaccacgctcgccatcggcgaagcctgcaagcaggcggggatggtggtgtccatcggcgtcaacgaacgcgacggcagcacgatctacaacacgcagctgctcttcgatgccgacggcaccttgattcagcgccgccgaaagatcagcccgaccttccatgaacgcatggtctggggccagggcgacggctccgggctgcgcgcggtcgacagcgcggtcgggcgcatcggccagttggcgtgctgggagcactacaacccgctggcccgctacgccatgatggccgacggcgagcagatccactcggcgatgtaccccggttccttcgcaggcgacgccttctccgaacagatccaggtcaacatccgccagcacgcattggaagccggctgcttcgtcgtgaacgccaccgcgtggctggacgccgatcagcaggcgcagatcatgcaggacaccggttgcgccatcggcccgatctccagtggttgcttcaccgccatcgtttcgccggacggcgtgttgctgggcgagcctctgcggtccggtgagggcgaggtgattgccgatctcgacttcacgctgatcgacaagcgcaagcagatgatggattcacgcgggcactatgcgcgcccggaattgctcagcctgttgatcgaccgcacggcgaccgcgcatgtgcatgagcgcagcgcgcatccgaaggcgactgccgagcaggcggacggtccatccgccgtgaatgcgcagtaa

SEQ ID NO: 318 - protein, 330 aa, Unknown
  Obtained from an environmental sample
MTIVKAAAVQISPVLYSREGTVDKVVQKILELGKQGVQFATFPETVVPYYPYFSFVQSGYALKVGKEHLRLLEQSVTVPSATTLAIGEACKQAGMVVSIGVNERDGSTIYNTQLLFDADGTLIQRRRKISPTFHERMVWGQGDGSGLRAVDSAVGRIGQLACWEHYNPLARYAMMADGEQIHSAMYPGSFAGDAFSEQIQVNIRQHALEAGCFVVNATAWLDADQQAQIMQDTGCAIGPISSGCFTAIVSPDGVLLGEPLRSGEGEVIADLDFTLIDKRKQMMDSRGHYARPELLSLLIDRTATAHVHERSAHPKATAEQADGPSAVNAQ

SEQ ID NO: 319 - DNA, 1017 bp, Unknown
  Obtained from an environmental sample
atgacgaccccgcgtatcgtccgcgtcgccgcggtgcagatggcgcccgacctggaatccgcacacggcacggtagacaaggtctgccgcgccattctggaggccggcgaaaaaggcgcgcgcatggtggtctttcccgagaccttcgtgccctactacccctacttctccttcatccagccggcggtgacgatgggcgccgcccacctcgagctctacgagcgcgcggtgacggtgcccggcccggtcaccctggccgtgggcgaagcggcgcggcgggcgggcgcggtcgtcgtgctcggcgtcaatgaacgcgaccacggctcgctctacaacacccagctgatcttcgacgagaccggcgcgctggtgctcaagcgccgcaagctcaccccgacctatcacgagcgcatggtgtggggccagggcgatggcagcggtctcaaggtggtggacaccggcatcggccgcatcggcgcgctggcctgctgggagcactacaacccgctcgcccgctacaccctgatggcgcagcatgaagagatccacgccgcgcagttccccggttccatggtcggccagatctttgccgaccagatggcggtgaccatccgccaccacgcgctggaatccggctgcttcgtggtgaacgccaccggctggctcaccgatgcgcagatcaccgccatcacccccgacccggccatgcagcgcgcgctgcgcggcggctgccacaccgccatcgtgtcgccggaaggcagctacgtctgcgaaccgctcaccgagggcgaaggcatgctggtggccgacctcgacatgcggctggtcaccaagcgcaagcggatgatggattcggtcggccactacgcccggccggagctgctttcgctcaacgccgatcttgcccccaagccggcgctgcacacacagccggctgcgtccctccctctctcccttcaggcaggagccgaccatgtcgacgacgaccgcaccgcgtccgcaacagctgatctctga

SEQ ID NO: 320 - protein, 338 aa, Unknown
  Obtained from an environmental sample
MTTPRIVRVAAVQMAPDLESAHGTVDKVCRAILEAGEKGARMVVFPETFVPYYPYFSFIQPAVTMGAAHLELYERAVTVPGPVTLAVGEAARRAGAVVVLGVNERDHGSLYNTQLIFDETGALVLKRRKLTPTYHERMVWGQGDGSGLKVVDTGIGRIGALACWEHYNPLARYTLMAQHEEIHAAQFPGSMVGQIFADQMAVTIRHHALESGCFVVNATGWLTDAQITAITPDPAMQRALRGGCHTAIVSPEGSYVCEPLTEGEGMLVADLDMRLVTKRKRMMDSVGHYARPELLSLNADLAPKPALHTQPAASLPLSLQAGADHVDDDRTASATADL

SEQ ID NO: 321 - DNA, 993 bp, Unknown
  Obtained from an environmental sample
atgagagttgtcaaagccgctgctgtccaactgagtcctgtcctccatagccgcgacggaacggtcgaaaaggtcgtgcggaagatccatgaactcgccgaagagggagtcgagttcgccacctttcctgagaccgtggtgccttactacccgtacttttccttcgttcagacgcccttgcagcaaatcttcggaactgagtatctgaggctgctcgaccaggcagtcaccgtgccatccgctgccaccgacgcgatcggcgaggctgccaggtgggctggacttgttgtctcgatcggcgtcaacgagcgagacgggggaactctctacaacactcagcttctcttcgatgccgacggcagcttaattcagcggcgtcgcaagatcacacccacccattacgagcgcatgatctggggccagggcgacggctcaggtctgcgggccgttgatagcaaggccggccgcattggtcagctggcatgctgggaacacaacaaccccctggcgcgctacgcgctgatggccgacggcgagcagatccattcggccatgtatccgggctccatgttcggcgactcgttttcccaaaagaccgaaatcaatatccggcagcatgcgctggaatctgcgtgcttcgtcgtgaacgcaacggcctggctggacgccgatcagcaggcgcaaatcatgaaggacaccggctgcggcatcggcccgatctccggcggttgcttcactgcgatcgttgcacccgatggtagcctgctgggcgaacccatccgttccggtgagggcgtcgtcgtcgccaacctcgacttcacgctgatcgacaggcgtaagcaggtgatggactcgcgaggccactacagccggccggagttgctcagcctcttaatagaccgcactcctaccgcgcacgttcacgaacgcgctacgcaccccacgacaggagctgagcaaggctccgaggatgtgttcgaggctcgcatttaa

SEQ ID NO: 322 - protein, 330 aa, Unknown
  Obtained from an environmental sample
MRVVKAAAVQLSPVLHSRDGTVEKVVRKIHELAEEGVEFATFPETVVPYYPYFSFVQTPLQQIFGTEYLRLLDQAVTVPSAATDAIGEAARWAGLVVSIGVNERDGGTLYNTQLLFDADGSLIQRRRKITPTHYERMIWGQGDGSGLRAVDSKAGRIGQLACWEHNNPLARYALMADGEQIHSAMYPGSMFGDSFSQKTEINIRQHALESACFVVNATAWLDADQQAQIMKDTGCGIGPISGGCFTAIVAPDGSLLGEPIRSGEGVVVANLDFTLIDRRKQVMDSRGHYSRPELLSLLIDRTPTAHVHERATHPTTGAEQGSEDVFEARI

SEQ ID NO: 323 - DNA, 951 bp, Unknown
  Obtained from an environmental sample
atgagcaacgtgaaagtcgcggtcgtgcaacgcgcgccggtgttcggcaaccgcgccgccaccctcgatcgcgccgtcgccgcgctggccgaagcggcgcagcagggggcgaagctggtcgtgatgcccgagcacttcatccccggctacccggcctggatctggcgcctgcgtccgggcaccgacctgcgattgtgcgaacagctgcacgcgatgctgcgcgccaacgccgtgaggctggatgacggtgacctggccccgttgaccgaggccgcgcagcggcatgcgctcaccgtggtctgcggcgtctgcgagatcgacaccgaattcagtcgcggcaccctgtacaacaccgtggtcgtgatcgggcccgacggcacgctgctcaaccggcatcgcaagctgatgcccaccaaccccgagcgcatggtctggggcatgggcgacgccacggggctgaaggtggtcgacacgccctgcgggcgcatcggcacgctgatttgctgggagaactacatgccattcgcacgcgccgcgctgtacgcgcagggggtcgaggtcctggttgcaccgacctacgacgaaggcccggtatggctggcgtcgatgcagcacatcgcccgcgaaggcggctgctgggtggtgggcaacggctgcgcattccagggccgcgacatgccggacaccttgccgggcaaggcccagctgtttcccgaggccgacgcctgggtcaacgccggggactcggtcatcgtcgcgccaggcggccggacagtggcgggtccgttgcacgaggcgttcgggctgttcaccgccgagatcgacctctcccgggtcggaatggcccggcgcagcctggatgtggccgggcactatggacggcccgacatcttctgcctgcaggtcaacgcccgggcgcagccgccggttgaggtgacgcaccatggctga

SEQ ID NO: 324 - protein, 316 aa, Unknown
  Obtained from an environmental sample
MSNVKVAVVQRAPVFGNRAATLDRAVAALAEAAQQGAKLVVMPEHFIPGYPAWIWRLRPGTDLRLCEQLHAMLRANAVRLDDGDLAPLTEAAQRHALTVVCGVCEIDTEFSRGTLYNTVVVIGPDGTLLNRHRKLMPTNPERMVWGMGDATGLKVVDTPCGRIGTLICWENYMPFARAALYAQGVEVLVAPTYDEGPVWLASMQHIAREGGCWVVGNGCAFQGRDMPDTLPGKAQLFPEADAWVNAGDSVIVAPGGRTVAGPLHEAFGLFTAEIDLSRVGMARRSLDVAGHYGRPDIFCLQVNARAQPPVEVTHHG

SEQ ID NO: 325 - DNA, 1077 bp, Unknown
  Obtained from an environmental sample
atgactgcaaaaaagattgtccgcgccgccgctgtccagctcaatcccgtgctggacagcgccgacggcacccttgtgaaagtgttgcaggcgattgccgacgccgcagcgcagggcgtgcaactgatcgtctttcccgagacggtggtgccctactatccttacttttccttcgtcacgcctgcggtttcgatgggcgcggcgcatctgaaactgtacgaacaatcgcccacggtgccaggtccactgaccgacgccgtcgccgcagccgcgcgggcacatcagatggtggttgtgctcggcgtcaacgagcgcgatcacggcacgctctacaacacgcaactgatcttcgacgccgacggcacgctcccactgaagcgtcgcaagatcacgccgacctatcacgagcgcatggtctggggcatgggcgatggctccggcctgcgcacggtgaagaccgaggtcggaaccgttggcgcgctggcctgctgggaacactacaacccgctggcacgctacgcgctgatggcgcagcacgaagagatccattgcagccagttccccggctcgctggtcggcccgatcttttccgagcagatggaaatcaccatgcgtcatcacgcgctggaatccggctgcttcgtcgtcaacgccactgcatggctgacgcctgagcaggtgcgatcacaggcgccaacaccggcaatggaaaaagccttctccggtggttgctacaccgcgatcatttcgccggaaggaaaacatctgggcgaacctcttcgcgacggcgaaggcatggtcatcgccgatcttgattttgatctcatcaccaagcgcaagcgaatgatggattcggttggccactacgcacggccggaattgttgagcctgcagctcgacaaccgatcaactgcaccgctgacaacgtcgccggtggccgccgcagcgccgtcgcttgcagagatggaagcacagcgcctgtcacgttatctcgatgccagctccggcagcgccgcacaaggcatcgaagccgcctacatcaatgccctcagctctttttcaggaaaaccctcatga

SEQ ID NO: 326 - protein, 358 aa, Unknown
  Obtained from an environmental sample
MTAKKIVRAAAVQLNPVLDSADGTLVKVLQAIADAAAQGVQLIVFPETVVPYYPYFSFVTPAVSMGAAHLKLYEQSPTVPGPLTDAVAAAARAHQMVVVLGVNERDHGTLYNTQLIFDADGTLPLKRRKITPTYHERMVWGMGDGSGLRTVKTEVGTVGALACWEHYNPLARYALMAQHEEIHCSQFPGSLVGPIFSEQMEITMRHHALESGCFVVNATAWLTPEQVRSQAPTPAMEKAFSGGCYTAIISPEGKHLGEPLRDGEGMVIADLDFDLITKRKRMMDSVGHYARPELLSLQLDNRSTAPLTTSPVAAAAPSLAEMEAQRLSRYLDASSGSAAQGIEAAYINALSSFSGKPS

SEQ ID NO: 327 - DNA, 975 bp, Unknown
  Obtained from an environmental sample
atggttgatcaaatacttaacgatcgttctgaattattaacagttggtttggcgcagattgctccaatctggctgaaccgcgaaaaaacacttgcgaaagtggttgagaaagtaaatcaagctgcaaagcaagattgtcatcttgttgcttttggtgaagctttggtccccggatatcccttttggattgaacttacagatggcgcgcgattcaactccaatgttcaaaaagaaattcacgcgcactatatggatcaggcagtacagatagagaatggtcatttaaaagcgctttgtgaaacatcggccgcaaacaagattgccgtgatcgttgggtgcattgaacgcgcagccgatcgcggcgggcacagcttatatgcttcattggtttttattaatcctcaagggcaaatcggatcggtgcatcgcaaacttatgccaacttatgaagaacgtttaacctggtcacctggcgatggacatggtttgcgaacgcatcaactaggtgctttcactgttggcggcttgaattgttgggaaaactggatgccattgccacgcgccgcattgtacgcacaaggtgaagactttcatgtcgcaatctggccgggaagcattcacaatacgcaagatattacgcgctatattgcgaaggaatccagatcgtttgtaatgtctacttccgggttcatgcgtaaagaagactttccatctgatacgcctcacttagacaaaatacttgcaaactctccgaatgtacttgcaaatggtggatcctgtctcgccggaccggacggtcagtggatcgttgaaccatttgtgaatgaggaaaaattagttgttgcgactgtgaaccacaagcaggtccgtgaagaaagacaaaattttgatccggtcggacactattcccgtcctgatgtcacgcagttgattgtgaacagacaaagacaatcaacaatcaagctcaacgattaa

SEQ ID NO: 328 - protein, 324 aa, Unknown
  Obtained from an environmental sample
MVDQILNDRSELLTVGLAQIAPIWLNREKTLAKVVEKVNQAAKQDCHLVAFGEALVPGYPFWIELTDGARFNSNVQKEIHAHYMDQAVQIENGHLKALCETSAANKIAVIVGCIERAADRGGHSLYASLVFINPQGQIGSVHRKLMPTYEERLTWSPGDGHGLRTHQLGAFTVGGLNCWENWMPLPRAALYAQGEDFHVAIWPGSIHNTQDITRYIAKESRSFVMSTSGFMRKEDFPSDTPHLDKILANSPNVLANGGSCLAGPDGQWIVEPFVNEEKLVVATVNHKQVREERQNFDPVGHYSRPDVTQLIVNRQRQSTIKLND

SEQ ID NO: 329 - DNA, 1023 bp, Unknown
  Obtained from an environmental sample
gtgccggccaaagtacgcgccgccgccgtgcagctcagccccgtgctcttcagccgtgaaggcacgaccagcaaggtctgcgacaagattgccgaggcggcggcgcagggcgccgagctggtggtgtttcccgaaaccgtagtgccgtattacccgtatttctcgttcatcaaggctccggccgtgatcggcgccgagcacttactcttgctcgaacaagccgtcacggtgcccgggcccagcgtcgaagccatcgcagaagccgctcgcaaggcgggcgcggtggtttcgatcggcgtcaacgaacgcgatcacggcacgctgtacaacacccagctgttgttcgacgccgacggtcggttggcgcaagcccgccgcaagatcacccccacgtatcacgagcggatgatctgggggcagggcgatggctcgggcttggtggcggtggatacgcgagtcggcaggattggctccctggcgtgctgggagcactacaacccgctggctcgctatgcgctgatggccgaccacgagcaaattcacgtggccatgttccctggctcgctcgtgggcgacatcttccgcgagcaaatcgaggtcacgattcggcaccacgcgctcgagtcgggctgcttcgtcgtcaacgcgacgggctacctgagcgacgcgcaggtgacgcagatcgcgggcgacaccaagctcgaccgcgccctgcgcggcggttgcttcaccgccatcgtatcgcccgagggcacgctgctggcgccaccgctcaccgacggtgagggcatggtcattgccgacctcgatctgtcgctcatcgccaaacgcaaacgcatgatggacagcgtcggccattacagccggcccgagctgctcagcgtgctgatcgaccgctcgccgcagccgcatttgcgcgagaaaactgcctctttacccgaacctcggatgtcccatgaatcgctcgctcccgatagtaacggcctccgcgacgctgacgcgaaagcctcgaccctctcctga

SEQ ID NO: 330 - protein, 340 aa, Unknown
  Obtained from an environmental sample
VPAKVRAAAVQLSPVLFSREGTTSKVCDKIAEAAAQGAELVVFPETVVPYYPYFSFIKAPAVIGAEHLLLLEQAVTVPGPSVEAIAEAARKAGAVVSIGVNERDHGTLYNTQLLFDADGRLAQARRKITPTYHERMIWGQGDGSGLVAVDTRVGRIGSLACWEHYNPLARYALMADHEQIHVAMFPGSLVGDIFREQIEVTIRHHALESGCFVVNATGYLSDAQVTQIAGDTKLDRALRGGCFTAIVSPEGTLLAPPLTDGEGMVIADLDLSLIAKRKRMMDSVGHYSRPELLSVLIDRSPQPHLREKTASLPEPRMSHESLAPDSNGLRDADAKASTLS

SEQ ID NO: 331 - DNA, 1041 bp, Unknown
  Obtained from an environmental sample
atgtccggaacaggacctatcggaccggtcgtgaaggtcgccgtcgtacaagccgcgccatgtctgctcgatcttgatgcgggcgtcgagaaggcgatcgccttgatcgaccaagcgggcaaggctggcgcgcggctcatcaattttcccgaaatttggctgccgggttatccttggtggatctggctgaatccacccgccatcaacatgcagtatgtcgcgccttacatgaacaactccattgtcgcaggcagcaagcatgaccacgcacttcgggccgccgcgcgccgcaacaatattcacgtcgtgatcggtgtctccgagcgcgccggcggcagtctgtacatggctcagtggcactatgggcccgagggcgaggtgatctcgcgtcgtcgtaagctaaaacccacccatgtcgaacgcagcgtctttggcgaaggcgacggcagcgacatgatcgttactcagaccgatttcgggcgcgtcggcgcgctatgctgttgggaacacctgcaaccgctgtcgaaatacgcgctcttttcccaggacgagcagattcattgcgcggcgtggcccgctttcagcctctatgcaaaactctcgaaggccttcagccccgaagtcagcgtcaacgtgaaccaaatctacgccgtagaagggcaatgcttcgtcctgtcgtcgtgctcggttatcgatcaggcgatctacgacacgttggtgcagaacgaattgcaccagaagttcctcgaggtgggcgggggctacagccgaatcttcgggccgaacggtgcggaattcggtgagaatctcccacccgatagggaaggcctggtggttgccgatatcgatctcggcctgatctcgcactccaagagtgccgctgatccggctggtcactacgcgagggccgacgctctggcgctcatgcataaccgtaatccccgccgtccggttatcggtttcggcgaggcgacgcgcaaggttgccgacgcactgcctaaaggcgcggaacccgcggaagcgctcgaagcggccgagtga

SEQ ID NO: 332 - protein, 346 aa, Unknown
  Obtained from an environmental sample
MSGTGPIGPVVKVAVVQAAPCLLDLDAGVEKAIALIDQAGKAGARLINFPEIWLPGYPWWIWLNPPAINMQYVAPYMNNSIVAGSKHDHALRAAARRNNIHVVIGVSERAGGSLYMAQWHYGPEGEVISRRRKLKPTHVERSVFGEGDGSDMIVTQTDFGRVGALCCWEHLQPLSKYALFSQDEQIHCAAWPAFSLYAKLSKAFSPEVSVNVNQIYAVEGQCFVLSSCSVIDQAIYDTLVQNELHQKFLEVGGGYSRIFGPNGAEFGENLPPDREGLVVADIDLGLISHSKSAADPAGHYARADALALMHNRNPRRPVIGFGEATRKVADALPKGAEPAEALEAAE

SEQ ID NO: 333 - DNA, 1038 bp, Unknown
  Obtained from an environmental sample
atggccattgaacatccccgctatcgggtcgctgccgttcaggcggcgccagagttccttaatctcgaggcaaccgttgacaagacgattgcgcttatcgaggaggccgcccgcggaggcgcaagtctcattgctttccctgaaacttggatacctggatatccatggtttgcctggcttggtgcgccgatctggggcatgaaattcatccaggcgtaccatgacaactcgatggtgatcgacggcgcccagtttgagcgtattgcgcaagcagcatcgcgttgcaacatcactgttgtgcttggctttagcgagaaggacgcaggaagcctgtatattgcccaggccatcctgagccctgaagggaagaccatcgccacgcgtcgcaagctgaaacccactcatgtcgaacgcgcgatcttcggcgaaggcgacggcagcgacctggcagttcacgacaccaagctcggcagggtgggcgccctttgctgctgggagcatcttcagccactttccaaatacgcgatgtatgctcagaacgagcaggtccatatcgccgcctggcccagtttttccctttacgtcgacgcggcttacgcgcttgggccagaggtgaacaacgccgcgagtcggttgtatgcggtcgagggccagtgcttcgtggttgcgccgtgtgcaacggtttcgcaaaagatgatcgatatgctttgcgagacacccgagcaacaagcgctcttgaagccggggggtggtcacgcgcaaatctacggtcccgacggacgatcgctggccgatccgctgcctccggacgcggaggggctgttgtatgcagacattgaccttgcagccatcaccctcgcgaaagcagctgcagatcctgctggccattactctcgccctgacgtgacacaactgctgcttgaccgcaatccaaagccccgtgtcgtgcatgctaagcccggccaaagcgccaacaacagctcacccggcatgcgggccgtcgagcataccgagctcgaagaaggtgaacaggcctga

SEQ ID NO: 334 - protein, 345 aa, Unknown
  Obtained from an environmental sample
MAIEHPRYRVAAVQAAPEFLNLEATVDKTIALIEEAARGGASLIAFPETWIPGYPWFAWLGAPIWGMKFIQAYHDNSMVIDGAQFERIAQAASRCNITVVLGFSEKDAGSLYIAQAILSPEGKTIATRRKLKPTHVERAIFGEGDGSDLAVHDTKLGRVGALCCWEHLQPLSKYAMYAQNEQVHIAAWPSFSLYVDAAYALGPEVNNAASRLYAVEGQCFVVAPCATVSQKMIDMLCETPEQQALLKPGGGHAQIYGPDGRSLADPLPPDAEGLLYADIDLAAITLAKAAADPAGHYSRPDVTQLLLDRNPKPRVVHAKPGQSANNSSPGMRAVEHTELEEGEQA

SEQ ID NO: 335 - DNA, 1053 bp, Unknown
  Obtained from an environmental sample
atgactacgcgcgtgattaaagtcgctgccgcgcagctgtctccggtgctggcaactgcatcggagcacagccgcgaggacacgattgcgaaagtgatcgacgccatcgctgcggcgtcgcaacagggcgcgcaactgattgtgtttccggaaacagtcgttccgtattacccgtatttttcatttatcacgcccgcggtaacgatgggtgccgaacatttgaaattgtacgaacaggcagtgacggtacccagcgcagcgacagatgctgtcgctgcggcggcaaaaaattatggcatggtagtggtgctcggaattaatgaacgcgatcacggctcgctgtacaacgcgcaattaattttcgacgccgatggtgagctgctattaaagcgtcgaaaaattacgccgacttatcacgaacgcatggtgtggggacaaggcgacggcagcggtttaaaagttgtcgatactgctgccggccgtgtcggcgcgctcgcgtgctgggaacattacaacccgctcgcgcgttacagcctgatggcacaacacgaagaaattcattgcagtcaatttccgggatcgttggtcggccctattttcgccgaacaaatggaaatcaccatgcgtcatcacgcactcgaatccggctgttttgtggtgaatgcaacggcctggcttagcgatacacaaatccaatcaattacccccgataaagccatgcagaaagcactgcgcggcggttgctacaccgcaatcatctcgcccgaaggcaaacatctgtgcccaccgctgtatgacggagaaggaataattgtggcggaattggacttcgcgttaatcaccaaacgtaaacgcatgatggattccgtcggccattacgcgcgaccagaactactttctttgctcctcgatgatcgcgtaactgcgccgctcaaaaacttacagacgacgatggcctctgccaaatccgctgaagatggttttcctttatttgcagacgttttatatccagacagttctttcattgagacgtcgaaattcgcggagtcatga

SEQ ID NO: 336 - protein, 350 aa, Unknown
  Obtained from an environmental sample
MTTRVIKVAAAQLSPVLATASEHSREDTIAKVIDAIAAASQQGAQLIVFPETVVPYYPYFSFITPAVTMGAEHLKLYEQAVTVPSAATDAVAAAAKNYGMVVVLGINERDHGSLYNAQLIFDADGELLLKRRKITPTYHERMVWGQGDGSGLKVVDTAAGRVGALACWEHYNPLARYSLMAQHEEIHCSQFPGSLVGPIFAEQMEITMRHHALESGCFVVNATAWLSDTQIQSITPDKAMQKALRGGCYTAIISPEGKHLCPPLYDGEGIIVAELDFALITKRKRMMDSVGHYARPELLSLLLDDRVTAPLKNLQTTMASAKSAEDGFPLFADVLYPDSSFIETSKFAES

SEQ ID NO: 337 - DNA, 957 bp, Unknown
  Obtained from an environmental sample
atgaagggagtgtgtgccatgtcgacgaaagttgccatcgtccaggcgccgccggtcctgctgcatcgcgacaggacgattgcgaaggtgcgttcgtcgatcgaggatgccgccaatgcgggcgcctcgctgatcgtatttcccgaagcttatgtacccggctatccgagttggatctggcgtctcaggcccggaggcgacatgggactgtcgtctgagattcacgcaagattgcgggaaaatgccgttgatctcgcgaacggaggcctggcgcatgtccagggggctgcagcaaaattcggcgcgactgtcgttatcggcatcaatgaactcgacagcgagttcagcggaacgacattgttcaacaccgtggtggtcatcggccccgacggaacgcgcctcaacaggcatcgaaaattaatgccgaccaacccggagcgcatggtgtggggcacgggcgatgcctcgggtctgcgtgtcatcgatacgccggcgggacggctgggaaccatgatctgctgggagagctacatgccgctggcgcgctatgctctctatgcgcaaggcatcgagatatacgtcgctcccacgtgggacgcaggcgagagctggattgctacgatgcgccacatcgccaaggaggccggctgctgggtgatcggcacggcaaccgtcatccagggcagcgatgttccggacgattttcccgaacgcgacaagctcttcaagccggaggagtggatcaacgacggcgatgcggtcgtggtcaagcccatgggcgcgattgctgccggaccgcacaatcgacagaaaagcatactctacgccgacatcgaccgggaggccgcgcggcgagcccgccggtcgctcgatgtctgtggccactattcccgcccagacgttttctctttctcggtcaaccgaaagccattccgccctgccgactttgtgggttga

SEQ ID NO: 338 - protein, 313 aa, Unknown
  Obtained from an environmental sample
MKGVCAMSTKVAIVQAPPVLLHRDGRLRRCVRRSRMPPMRAPRSYFPAYVPGYPSWIWRLRPGGDMGLSSEITQDCGKMPLISRTEAWRMSRGLQQNSARLSLSASMNSTASSAERHCSTVVVIGPDGTRLNRHRKLMPTNPEHGVGHGRCLGSACHRYAGGTAGNHICWESYMPLARYALYAQGIEIYVAPTWDAGESWIATMRHIAKEAGCWVIGTATVIQGSDVPDDFPERDKLFKPRSGSTTAMRSWSSPWARLLPDRTIDRKAYSTPTSTGRPRGEPAGRSMCGHYSRPDVFSFSVNRKPFRPADFVG

SEQ ID NO: 339 - DNA, 1020 bp, Unknown
  Obtained from an environmental sample
atgtcaggatcattcaaagttgcagcagtgcaggcggctccggccttcctcaatctcgatgcgggcatcgacaaggcggtggcgctgatcgagcaagccgccgcgcaggacgttcagctcatcgcctttcccgagacctggttgcccggatacccctggtggatctggctcgatgcacccgccgttaccatgggctatgtcgttccctacaatctcaattcactagaggcgggcagcccgcaggacaagcgtctggcaaatgccgcgcgtgagaacaacatccaggtggtgatgggtctgtctgaacgccatgacggcacgctctacatcgcgcagtggcactatggtgaagatggcgaggtgatctcgcgacggcgcaagctcaagccgacccatgtcgaacgcacggtgttcggggaaggcgacggcagcgacatggtggtcaaggacacaagtctgggacgggtcggcgctctgtgctgttgggaacacctgcagccgctcaacaaatacgcgatgtactcccagaacgagcagatccacatcggttcctggcccagcttcagcctctacaagggcggcgcctatgcgcttggggcagacctcaacacggcggcaagccagatgtatgcggccgagggccagtgctttgttctggctgcctgcgccacggtcagtcaggacatgttcgacatgctctgcgacacggaaatgaagcagcagttcctgaccaccggtggcggattcgcccgcattttcggacctgacggctcgcccatgggcaatgtgcttgaagaacatgaagaagggctggtgatcgccgaaatcgatctcaccatgattgcgatcgccaaggcggcggctgacccgtgcgggcactattcccggcccgatgtgttccgactgatgttcaaccagaagccaagcccggtggtgatgccattcgaaaacgacgtggcccgcgagattgtcgaggccgccgaggatcaggtcagcgcaaaccggctcgcagcggaatga

SEQ ID NO: 340 - protein, 329 aa, Unknown
  Obtained from an environmental sample
MSGSFKVAAVQAAPAFLNLDAGIDGGGADRASRRAGRSAHRLSRDLVAGYPWWIWLDAPAVTMGYVVPYNLNSRGGQPAGQASGKCRAEQHPGGDGLSERHDGTLYIAQWHYGEDGEVIATAQAQADPCRTHGVRGRRRQRHVVKDTSLGRVGALCCWEHLQPLNKTRCTPRTSRSTSVPGPASASTRAALCAWGRPQHGGKPDVCGRGPVLCSLPAPRSVRTCSTCSATRKSSSSTGGGFARIFGPDGSPMGNVLEEHERAGDRRNRSHHDCDRQGGGPVRALFPARCVPTDVQPEAKPGGDAIRKTWPARLSRPPRIRSAQTGSQRN

SEQ ID NO: 341 - DNA, 1056 bp, Unknown
  Obtained from an environmental sample
atggcactgaccaacccaaaatataaagtcgccgccgtccaggccgcgccagcgttcctcgatctggatgcgtccgtcgaaaaagcggtccggctgatcgacgaggccggcgccaagggcgcgcgcctcattgcgttcccggaaacctggatccccggctatccctggtggatctggctcggcgcgccggcctgggcgatcatgaaaggttttgtctcggcctatttcgacaattcgctcacctatgacagtccggccgcggacaaattgcgccaggccgccaagcgcaacgatatcgtcgtggtgctcggcctgtcggagcgcgacggcggcagtctctatatcgcgcaatggatcatcggcccggacggcgaaactgtcgcccagcgccgcaagctcaagccgacccatgtcgagcgttcggtgttcggcgagggcgatggcagcgaccttgccgtgcatgagctcgcgatcgggcgcgtcggcgcgctgtgctgctgggagcatctgcaaccgctgtcgaaatacgccatgtatgcgcagaacgagcaggttcacgtggcggcctggccgagcttttcgctgtacgatccgttcgcccatgccctcggtgcggaggtcaacaacgccgccagcaagatctacgcggtcgagggatcgtgcttcgtcgtggcaccctgcgccaccgtttcaaaggaaatgatcgacctgttgtgcgacacgccggacaagcacggtctgctgcacgccggcggcgggtttgccgcgatctacggccctgacggctcgccgatcggcgaccgcctggcgcccgaccaggaaggtctgatctatgccgatgtcgatctcggcatgatctcggtcgcgaaggccgccgccgatccggccggacattatgcgcggccggatgtcacaaggttgctgctcaacaaacgcccgggcaatcgtgtcgaggcgctggcacttccggtggatcaggttgcggcaggtgaggagatcccctcgatatcgcgatcggccagaggggttgccgaactgccaaacgcggccgaatag

SEQ ID NO: 342 - protein, 342 aa, Unknown
  Obtained from an environmental sample
MALTNPKYKVAAVQAAPAFLDLDAPSKKRSGSTRPAPRARASLRSRTWIPGYPWWIWLGAPAWAIMKGFVSPISTIRSPMTVRPRTNCARPPSATYRRGARPVGARRRQSLYRAMDHRPTAKLSPSAASSSRPMSSVRCSARAMAATLPCMSSRSGASARCAAGSICTAVEIRHVCAERAGSRGGLAELFATIRSPMPSVRRSTTPPARSTRSRDRASSWHPAPPFQRKSTCCATRRTHGLLHAGGGFAAIYGPDGSPIGDRWRPTRKVSMPMSISASRSRRPPDPAGHYARPDVTRLLLNKRPGNRVRRWHFRWIRLRQVRRSPRYRDRPEGCRTAKRGRI

SEQ ID NO: 343 - DNA, 942 bp, Unknown
  Obtained from an environmental sample
atgaagtcaaaaattgcggttattcagcgacctcctgtattgttagaccttcaggcttcaatcgcccgtgccattacttctgttgaggaagcggcaggcaagggatctgagctccttgtttttcccgagacatttctgcctggttatccgtcctggatctggcgtctcaagccgggcggagacatggtgctgacatctgaaatccacgcaaaatatcgcgcgaactctgttgatgttgagcgcggggatctggcccctttatgcgaagcggcggcgaaacacggcgtcacaattgtcatggggctcagtgaaattgatgggcgctacagcgggactacactctttaatacagtggtgaccattggcgcggaaggagagctccttaatagacaccgcaagctcatgccgacaaacccagagcgtatggtctgggggcaaggggatgcctctggtctgcgggttgtcgacacgcccgtgggccgcgtcggcacgctgatctgctgggaaaactacatgccgctatcgcgctatgcgctttattctcaaaacattgacatctatgtggcgccgacctgggacgcgggcgagagctggatcgcctccatgcagcatatcgccaaagaaggtggctgctgggtgatcggcacggccacggcgatggagggctctgatgtcccagccgacttccctcagcgggaggtgcttttccctgatagcagcgaatggatcaatgacggtgacgctgtagtggttaaacccatgggggcgattgtcgcgggtccgcatcaccgggataagagtattctctatgctgagattgacgtcgaagtggcacgcaatgcgcggcgctcgctcgatgtggcggggcattactcccggccggatattttttcctttggcgtggatcgccggcctttgccgccggttacgtttgaggattga

SEQ ID NO: 344 - protein, 303 aa, Unknown
  Obtained from an environmental sample
MKSKIAVIQRPPVLLDLQASIARAITLLRKRQARDLSSLFFPRHFCLVIRPGSGVSSRAETWCHLKSTQNIARTLDVERGDLAPLCEAAAKHGVTIVMGQNWALQRDYTLYSGDHWRGRRLLNRHRKLMPTNPERMVWGQGDASVCGLSTRPWAASARSAGKTTCRYRYALYSQNIDIYVAPTWDAGESWIASMQHIAKEGGCWVIGTATAMEGSDSQPTSLSGRCFSLIAANGSMTVTLWLNPWGRLSRVRITGIRVFSMLRLTRSGTQCAALARCGGALLPAGYFFLWVDRRPLPPVTFED

SEQ ID NO: 345 - DNA, 1011 bp, Unknown
  Obtained from an environmental sample
atgaaagcgatcaaggccgctgccgtgcaggcagcaccggtattcctgaacctcgacgcatcgatcaccaaggcggaaacattcgtcgccgaggccgccgcgaatggtgccaagctggtggcgtttccggaaacctggctgccgggctatccctggttcatctggctcggtgcgcccgccgaaggcatgcagttcatcccgcgctatcacgaaaacagcatggagctccgctcgcccgagatgcgccgcttgcaggcgatcgcgcgcaagtatgaagtgacgctcgtcatgggctattccgagcgcgatggtggcagccgctacatgtcccaggtcattattggcgatcagggcgacatccttctcaatcgccgtaaattgaagccaacccatgtcgagcggacggtcttcggcgaaggcgacggttcggacctggtggtggtcgaaacggcattcggcaggctcggtgcgctcaattgctgggaacatatccagccgctcgtcaagatgtcgatgtatgcccagcatgaggaaatccatgtcgcgggttggccgagcttctgcgtctaccgcgatctcgcctatgccctgggaccggaagtcaacaatgccgtcagtcaggtctatgccgtggagggtagcgcctatgttctggcaccctgtgcgatcgtaagccaggagatgttcgacattctggccgacaagcctgaaaaggcctttctcctcaatccccgcacatccaagcccggcggtggcttcacgcagatctatgcgccggatggtcgaccgctttgcgagccgcttgccgacgatgtggaaggcatcctctatgccgatctcgatccggcaacgatcgccgtcgcgaaggcggccgccgatcctgcggggcactattcgcggccggacgcactctcgctggtgatcaatcgcgaaaagcgcgcggtgatggctgaaatcaacgcgccggcgacgccgaccttcacccccatctccctggacgctgcggagtag

SEQ ID NO: 346 - protein, 329 aa, Unknown
  Obtained from an environmental sample
MKAIKAAAVQAAPVFLNLDASITKAETFVAEAAANGAKLVAFPETWLPGYPWFIWLGAPAEGMQFIPRYHENHGAPLARDAPLAGDRAQVSDARHGYSERDGGSRYMSQVIIGDQGDILLNRRKLKPTHVERTVFGEGDGSDLVWSKRHSAGSVRSIAGNISSRSSRCMYAQHEEIHVAGWPSFCVYRDLAYAWDRKSTMPSVRSMPWRVAPMFWHPVRSARRCSTFWPTSLKRPFSSIPAHPSPAVASRRSMRRMVDRFASRLPTVEGILYADLDPATIAVAKAAADPAGTIRGRTHSRWSIAKSARWLKSRAGDADLHPHLPGRCGV

SEQ ID NO: 347 - DNA, 909 bp, Unknown
  Obtained from an environmental sample
atgaaagtcgcggcgattcaagcggcgccggtctacttggaccggcaagccacgctggaaaaggcgctttctctaatggatgaagcggccgcaaacggcgcccaagtctgcgccttccctgagaccttcctcgcgggctatcccgtctggatggacttgacggacggcgccaagtggaatgacgacaaacaaaaagcggcctacgcatgttatgtagatgcggccgtcgaagccgacggacctgagttgcaagccattgccaagaaatcgaaggcgctcggcctgttcacctatctgggcatggtcgaacgcgcggcgtcggccgggtcagtatattgttccctcgctgccttcgatcccgacaagggtctcgtcagcctacaccgaaaactcatgcccacctacaccgagcgcctcgtgtggagccaaggcgacggacacggactccaggtgcatgaattcgccggcttcaaaatcggcgcgctaaactgctgggaaaattggatgcccctcgcccgttacgcaatgtacgcccagggcgaacagctccacgtcgcgacctggcccgggtccccctggctcaccaaggacatcacccgtttcatcgcccttgagggacgcatctacgtcatgtccgttggcggcgtccttagcgcaaacgatatccccgactccttcccgcttaaaaccgacctcctcaagatccgagaccgctacctcagcggcggcaccatgatagtcgccccagacggcaccaccctcgaaggccccgccaaaaacgaagagaccatactctacgcggagctcgacctcaacaccgtcctccaagaacgccaaaatttcgatcccgcgggacactacgcgcgcccagacgtcttccaattggaaatcgacaaaaatcgacgatag

SEQ ID NO: 348 - protein, 297 aa, Unknown
  Obtained from an environmental sample
MKVAAIQAAPVYLDRQATLEKALSWMKRPQTAPKSAPSLRPSSRAIPWMDLTDGAKWNDDKQKAAYACYVDAAVEADGPELQAIAKKSKALGLFTIWAWSNARRRPGQYIVPSLPSIPTRVSSAYTENSCPPTPSASCGAKATDTDSRCMNSPASKSARTAGKIGCPARYAMYAQGEQLHVATWPGSPWLTKDITRFIALEGRIYVMSVGGVLSANDIPDSFPLKTDLLKIRDRYLSGGTDSRPRRHHPRRPRQKRRDHTLRGLDLNTVLQERQNFDPAGHYARPDVSNWKSTKIDD

SEQ ID NO: 349 - DNA, 1002 bp, Unknown
  Obtained from an environmental sample
atgacgtcccctgttcaaaccaagtacaaagtcgcctgtgttcaggcggcgcccgagtttctcgatctcgacaaaggcgttgccaaagcggtgcgcctgatcgaagaagccgccacccaaaaggcctcgctgatcgcgtttcccgaagtctggctccccggctatccgtggtggatctggctcgactcgccggcctggggcttgcagttcgtccagcgctacttcgaaaacgctctggtcgtcggcagcccccaatgggagcgcttgtgcaaggccgccgccgacaacaatatccatgttgtgctcggattctccgaacgggacggcagcacgctgtacctcgcacaggccatcatcgataacaccgggaaggtgatcgccacgcggcgcaaactcaagccaacacacgccgaacgcacggttttcggcgaaggcgacgggagccacatcgcggtgcatgaaaccactttgggccgcatgggtgcactctgctgcgccgagcacatccagccactgaccaagtacgccatgtactcgcagcacgagcagattcacattgccgcatggcccagcttctcggtctaccgcggagcagcgttccagctgagcgccgaagccaacaacgccgcgagccaggtctatgccctggagggcagttgctacgtggtggccccttgcgcgacggtgtccaaggagatgttggacatgctggctgattcgccgcaaaagaagcagctcctgctggaaggcggtggctacgccatgatttatgggcccgacgccaagcccctgtgcgagcccattccagagacagaagaaggcattctttacgcagatgtggacctgggcttcatcggtgtcaccaaggcagcgtatgaccccgccggtcactattcacgccccgacgtgctgcgccttttgttcaatcggaagcctgcccctcgggttcacgatttcgatcctgaatacacggccaccgagcagaagacagacgcggcctga

SEQ ID NO: 350 - protein, 333 aa, Unknown
  Obtained from an environmental sample
MTSPVQTKYKVACVQAAPEFLDLDKGVAKAVRLIEEAATQKASLIAFPEVWLPGYPWWIWLDSPAWGLQFVQRYFENALVVGSPQWERLCKAAADNNIHVVLGFSERDGSTLYLAQAIIDNTGKVIATRRKLKPTHAERTVFGEGDGSHIAVHETTLGRMGALCCAEHIQPLTKYAMYSQHEQIHIAAWPSFSVYRGAAFQLSAEANNAASQVYALEGSCYVVAPCATVSKEMLDMLADSPQKKQLLLEGGGYAMIYGPDAKPLCEPIPETEEGILYADVDLGFIGVTKAAYDPAGHYSRPDVLRLLFNRKPAPRVHDFDPEYTATEQKTDAA

SEQ ID NO: 351 - DNA, 936 bp, Unknown
  Obtained from an environmental sample
atgattacagcaggcatcgcagtcgccgctccggtggtgttggacaaaacaaaaaccattgagaaagccgttggcattattcacgaggcagcgggtaagggtgtgaacctgcttgtgtttcccgaggcatttattccctcctatcccgcctggggttggcgcctgcgtcccggtggagatttcgggttgtgcgaggagttgcacgccctgttgcttgataattcggtaaatttgcaaggtgatgacctggaccctgtccggggcgctgcagccgagcattcaatgaccgtggtgatgggattgaatgagcgcgaaggccagttcggtcgggctaccctgtttaacgccatggtatttatcggtccggacggcagcatcctgaaccatcatcggaaacttatgccaaccaatcatgagcgtacgattcatggcttcggcgatgcgcggggattgaaagtggtggataccccgtgcggtcgcgtgggtggtctgatttgctgggagaatttcatgcccctggctcgctacggcctgtatgcccagggcgtagaagtgtatgttgcgcccacctacgaccagggtgatgggtggataggatccatgcagcatattgcccgggaaggacggtgctgggtgttatcggccggaacaccgctacgcggcagtgattttcccgcggacatgccgggcaaggctcaactgtttcccgatgacgatgaatgggtgaatcccggtgggtcagtggttatcgcaccgggtggggaattagtggctggaccgcttttccgtgaggagggcatccttgtctgtgaattggatccggcgaaaagtgctcatgccaagcggtcctttgacgtggccggtcattacgccaggccagatattttcgagttggaaatagaccgtgatccacaggatcccgtcgagtgggactga

SEQ ID NO: 352 - protein, 301 aa, Unknown
  Obtained from an environmental sample
MITAGIAVAAPVVLDKTKTIEKAVALFTRQRVRVTCLCFPRHLFPPIPPGVGACVPVEISGCARSCTPCCLIIRNLQGDDLDPVRGAAAEHSMTVVMGEARRPVRSGYPVRHGIYRSGRQHPEPSSETYANQSAYDSWLRRCAGIESGGYPVRSRGWSDLLGEFHAPGSLGLYAQGVEVYVAPTYDQGDGWIGSAAYCPGRTVLGVIGRNTATRQFSRTCRARLNCFPMTMNGIPVGQWLAPGGELVAGPLFREEGILVCELDPAKSAHAKRSFDVAGHYARPDIFELEIDRDPQDPVEWD

SEQ ID NO: 353 - DNA, 1035 bp, Psuedomonas putida ATCC 700801
atgaatgcttcaaaaacacattataaagttgcagctgtgcaagccgctcctgaattcctggatttggacaaaggggttgataaggctatacgcctcattaaagaagcagctgataacggagcatcgctggttgcctttccggaagtttatcttccagggtatccgtggtggatctggcttggctctcccgcatggggaatgcagtttgttcagcgctacgtagaaaactcgcttgatttaaaaagcgagcagttcgagcgactgtgcaaagcggctgctacttaccgtattcacgttgtaatgggttacagcgaacgctcgtttggcaccctctacctcggtcaagcaattatcgatgacagcgggaaagtaattggtacgcgccgtaagctcaagcccacccatgctgagcgtactgtttacggtgagggtaacggcagtgacctcagggttttcaattcgcaacttggaagggtaggtgcactctgctgcgcagagcacgtacaaccactctcgaagtttgcgatgtacagccagcatgagcagttgcacattgcctcttggccgagcttctcggtatatcgcggtggcgcatatcaactgagcgctgaggctaactgcgcggccacccaagtctatgctcttgaaggccagtgcttcgtaatttcagcatgcgcaatcgtatctaaagacatgctaaacgttctcatcgacacccctgacaagggtaacctgttgcaggatggcggtggcttcgcgatgatttatggccccgatggcgcaccgctgtgtgaacccctgggcgaacatgaagaaggcatcctttatgccgacgtcgatttgggcgccatttccgtagctaaagcggcactcgacccggttggccattactcgcggccagatgttttgcgtctgcttttcaacgatcaaccgacaccttgcgtggaggcgttcaatccggctcctgtcggtactgatgctccaggtacagaccttcagggtgatgagcccgatgcgcaaccgatatctgaataa

SEQ ID NO: 354 - protein, 312 aa, Psuedomonas putida ATCC 700801
MNASKTHYKVAAVQAAPEFLDLDKGVDKAIRLIKEAADNGASLVAFPEVYSRVSVVDLAWLSRMGNAVCSALRRKRLIKASSSSDCAKRLLLTVFTLWLQRTLVWHPLPRSSNYRQRESNWYAPAQAHPCAYCLRGRQPQGFQFATWKGRCTLLRRARTTTLEVCDVQPAAVAHCLLAELLGISRWRISTERGLRGHPSLCSRPVLRNFSMRNVSKDMLNVLIDTPDKGNLLQDGGGFAMIYGPDGAPLCEPLGEHEEGILYRRRFGRHFRSSGTRPGWPLLAARCLRLLFNDQPTPCVEAFNPAPVGTDAP

SEQ ID NO: 355 - DNA, 1014 bp, Unknown
  Obtained from an environmental sample
atggccgtctctaaagacggtactgtttcaggaaagtcgcctatccgattgcatgtcgccgcgatacagatggtcccaaagctgggtgacgcgcaggcgaacgtgaatcaggcagaagcccttattcggaaggctcttgggctgggtgcgcgttggatcgtgttaccagagatgtttacctccggtgcggcgtttcatcccgacatgctcaaagccattcagccattcgatggcgccccactccagttgctgaaagacctttctcgcaagggcaatgctgtcatcggcggctcgtttctcgccaagcgtgggcaacaagtattcaataccttcgttttggtttctccggacgggtcagtcgtaacgcatgacaaggattcaccgacctattgggaaaattgctattaccggggcggtaccgatgatggcgtgttgtctacgcccattggcccggtcggctccgtcctctgttgggaatttatccgctcaagaaccgcgagacggctggcgaacaaggtcaagatggtcgtgggaggctcctgttggtggacgctccccgatgatgctgatccagacagcccgcgcagagccgtgaacctcaagatgctgcaagaagcgccggttcgcatggcgcggatgctgggtgttccggtaatacatggctcccacgcgggcagcttcgaaggattcttcagtccggaacttgcggatgttccctataactcgacgtacctgggcgagacaatgattgtcgacgcgggtggccgggtacttgcccgtagagcgcaagatgcaggcgaaggcgtggtaacggcagaagtggttttgcccgacaagtccgtaccaagcgaacccatcccggagactttctggattcccaaggaaatgccggatgattggaaagaagcctgggagcgttggttcgataccggtgcggattactacgagatggtgaccgcgccctttatcaagacgggtgtgataaacgagtacacaccggaatatcttaggtag

SEQ ID NO: 356 - protein, 325 aa, Unknown
  Obtained from an environmental sample
MAVSKDGTVSGKSPIRLHVAAIQMVQSWVTRRRTIRQKPLFGRLLGWVRVGSCYQRCLPPVRRFIPTCSKPFSFDGAPLQLLKDLSRKGNAVIGGSFLQAWATSIQYLRFGFSGRVSRNAQGSPTYWENCYYRGGTDDGVLSTPIGPSAPSSVGNLSAQEPRDGWRTRSRWVGGSCWWTLPDDADPDSPRRAVNLRCCKKRRFAWRGCWVFRYMAPTRQLRRILQSGTCGCSLLDVPGRDNDVDAGGRVLARRAQDAGEGVVTAEGFARQVRTKRTHPGDFLDSQGNAGIGKKPGSVGSIPVRITTRWPRPLSRRVTSTHRNILG

SEQ ID NO: 357 - DNA, 951 bp, Unknown
  Obtained from an environmental sample
atgacaaaactagccatcgtacaaaaaccgccagtctttctggataagcaaaaaaccattgagctggccgtcgccaacattgaagaggccgccgccaagggtgccgatctcgtggtgttttctgaagctttcattcccggctatcctgcctggatctggcgtctacgccccggcggtgactgggggctttcagaagagttgcaccagcgtttgctgcgcaatgccgtcaatgtggactccgatgatctggctccgttgtttgaggtcgcccgcaagcacgaactcaccatcgtttgcggtatcgaggagcgtgacaacaaactaagtcaaacaaccttatataacaccgtcatcacgattggtcccgatggatcgttactgaacaaacatcgcaagcttatgcccaccaacccggagcgaatggtgtgggggtttggtgacgcatccggtttaaaagtcgttgataccaatgctggtcgaattggctcattaatgtgctgggaaaattacatgccgctggctcgctatgccctatatgcacaaggtgtcgagatctatatcgcaccgacctacgacagcggtgatggctggataggcagcatgcagcacatcgcacgtgaagggggctgttgggtggtgggatgtgggtgtctcatgaaaggcagtgatattccagatgatttcccggagaaatccacgttgtatccagatgcagatgaatgggtgaacccgggtgattctgtagtgatagcacccggcggtgaaattatggccggcccaatgaacagagagtccggtattttgtatcacgagctagacagagaaaaagtcagcaacgctaaacgagcattcgatgttgccgggcattattcacgtcccgatatctttcagctgcatgtaaatacacaggagcagtcaccctgcgtattcgaaaataattccataacttaa

SEQ ID NO: 358 - protein, 300 aa, Unknown
  Obtained from an environmental sample
MTKLAIVQKPPVFLDKQKTIELAVPTLKRPPPRVPISWCFLKLSFPAILWIWRLRPGGDWGLSEELHQRLLRNAVNVDSDDLAPLFEVARKHELTIVCGRGAQQTKSNNLIHRHHDWSRWIYTNIASLCPPTRSEWCGGLVTHPLKVVDTNAGRIGSLMCWENYMPLARYALYAQGVEIYIAPTYDSGDGWIGSAAHRTRGLLGGGMWVSHERQYSMISRRNPRCIQMQMNGTRVILTRRNYGRPNEQRVRYFVSRARQRKVSNAKRAFDVAGHYSRPDIFQLHVIHRSSHPAYSKIIPL

SEQ ID NO: 359 - DNA, 1029 bp, Unknown
  Obtained from an environmental sample
atggcaaacgtcgttcgtgctgcggccgtacagttgagccctgttttgggtagtcgcgagggtacggtagagaaggtagttgctgcgatccgtgacgccgcctcgcagggcgcacagctgtgcgttttcccggagacggttgttccctattatccgtatttctcgttcattcggccgcccgcggccatgggcaaagaccacatgcagctgtacgagcaagctgtggtcgtgccttctcccagcacgaacgcgattgccgcggcggccaaacaacactcgatcgtcgtttcaatcggcgtcaatgaacgcgatcacggtacgatatacaacacgcagttgttgttcgatgccgacgggacactcgtgcaacggcgtcgcaagataacccccacgttccacgagcgtatggtgtggggtcaaggtgatgggtcgggtttgcgctgtgtcgacacacaaatcgggcgcatcggtagcctggcttgttgggaacattacaatcccttggcgcgctacgcattgatggccgatcacgaagagatccacgtcgccatgtttccgggttcgatggtgggtcagatcttcgccgatcaaattcaggtaaccattcgccaccacgcgctcgaaagcggctgtttcgtcgtcaacgctacggggtatctgagcaaggaacaggtcgcccagttgtcacaaggcacgtcgctcgacgcggcgttgaccggtggttgttacaccgcgattgtatcgcctgaaggcgtcgtactgggcgaaccgctcaccgacggcgaaggcatggtcgtggcggatatggatctcagcctcatcaccaaacgcaaacgcatgatggatagcgtcgggcactacagtcgcccggaattgctgtctctgctgatcaatcgaacgccaacccacacggcggtcgacgtcgaattcaactccaattccgagtctcatcatgtcagcaatacacgaacaccaaagcgcacaactggcccacgttcgaaccttcaagttgccgctgatcgcgagtaa

SEQ ID NO: 360 - protein, 335 aa, Unknown
  Obtained from an environmental sample
MANVVRAAAVQLSPVLGSREGTVEKVVAAIRDAASQGAQLCVFPETVVPYSVFLVHSAARGHGQRPHAAVRASCGRAFSQHERDCRGGQTTLDRRFNRRMNAITVRYTTRSCCSMPTGHSCNGRKITPTFHERMVWGQGDGSGLRCVDTQIGRIGSLACWEHYNPLARYALMADHEEIHVAMFPGSMVGQIFADQIQVPFATTRSKAAVSSSTLRGIARNRAQLSQGTSLDAALTGGCYTAIVSPEGVVLGEPLTDGEGMVVADMDLSLIPNANAWIASGTTVARNCCLCSITPTHTAVDVEFNSNSESHHVSNTRHQSAQLAHVRTFKLPLIAS

SEQ ID NO: 361 - DNA, 951 bp, Unknown
  Obtained from an environmental sample
atgctaaacgagaacaatggcgctactttcaaggttgctgccgtgcaggcttcaccggtatttcttgatcgcgctgctacaatcgacaaggcttgcgatttaattgctacggccggacgcgagggggctcgcctgatcgtctttccagaagcgttcgtcccggcctatcctgattgggtatgggcgattcccgcgggtgatgagggcatgctcaatgagctgtatgcagaattacttgccaatgctgtcaccattcccagcgatgcgaccgagaggttgtgtcgcgcggcgcggcttgctaatgcttacgtggtgatggggatgagcgaacgcaatgccgaagcgagtggcgccagcctgtataatacgctgttgtatattgatgcacagggacaaatcctgggaaagcaccggaagctggttccaacgggcggcgagcgcctggtatgggcacagggagatggcagcaccctggaggtttacgatactcctttgggaaaactcggtggcttaatctgctgggagaattatatgccgctggcacgctatactatgtatgcctggggcacgcaaatctacattgcagcgacgtgggatcgcgggcagccatggctatccactttgcgacacattgctaaagagggcagagtatatgtgatcggctgttgtattgctatgcgcaaagatgatatccccgaccattacgcgatgaaggagaagtattacgcggaagaagacgagtggatcaatattggcgatagcgcaatcgtcaatccagaaggggtatttattgccgggccagtgcgtaagcaagaagaaatcctctacgccgaggttgacccgcgaatgatgcaggggccaaagtggatgctcgacgtggcaggacattacgcgcgcccggatgtattccagttgacggtgcacacggagaggcggcagatgatccactag

SEQ ID NO: 362 - protein, 302 aa, Unknown
  Obtained from an environmental sample
MLNENNGATFKVAAVQASPVFLDRAYNRQGLRFNCYGRTRGGSPDRLSRSVRPGLSLGMGDSRGGHAQAVCELLANAVTIPSDATERLCRAARLANAYVVMGMSERNAEASGASLYNTLLYCTGTNPGKAPEAGSNGRRAPGMGTGRWQHPGGLRYSFGKTRWLNLLRIICRWHAILCMPGARKSTLQRRGIAGSHGYPLCDTLLKRAEYMSAVVLYAQRYPRPLRDEGEVLRGRRRVDQYWRRNRQSRRGIYCRASAARRILYAEVDPRMMQGPKWMLDVAGHYRARMYSSRCTRRGGRST

SEQ ID NO: 363 - DNA, 1053 bp, Unknown
  Obtained from an environmental sample
atgccgaaaaagtcgaccgtccgggtcgcagccgtccagattgcgccggatctgacatcgcgggaaaagacggtggcacgcgtgatcgaggcgatcgcccaggcatccgccaaaggtgcggagcttgtggtttttcccgagacctttgtgccgtggtatccttatttctcgttcgtgttgcccccggtcttgtcgggcaaggagcacctgcggctctacgaagaggcggttgcggtgccaagtgccgccacaagaagcgtagcggctgccgctcgcgaacatggcatcgtcgtggcgcttggcgtcaacgagcgcgactatggcacgctctacaatacgcaactgcttttcgatgccgatggcagtctgatcctgaagcggcgcaagatcaccccgactttccacgagcggatgatctggggccagggcgatgcctcaggcctgaaggttgtcgacagcgccattggccgcatcggcgcgctggcctgctgggaacactacaatccgctagcccgctatgcgctgatggcgcagcacgaggaaatccacattgcgcagtttcccggctccatggtcgggccgatctttgccgatcagatggaggtgacgatccgccatcacgcgctggaaagcggctgcttcgtcgtcaatgccacgggatggctgacggatgatcagatcgtctcgatcacaccggataccggcctgcaaaaagcgctgcggggtggctgcatgacggcgatcatttcccccgaaggcaagcatctcgtgccgccgctcaccgaaggtgagggtatcctcgtcgccgatctcgacatgagcctcattctcaagcgcaagcgcatgatggattcggtcggccactatgcccggcccgagttgctgcacctcgtcatggacgcccggccggctgcgccgatgagggaatcgtccatgcccactgccttccccggcgaaacattgacaaccgacatgaccgatggagaacaggatgcgtctttcgacggaaacgctgatcaacgaattgcagtccttcggagcccggctggttga

SEQ ID NO: 364 - protein, 335 aa, Unknown
  Obtained from an environmental sample
MPKKSTVRVAAVQIAPDLTSREKGGTRDRGDRPGIRQRCGACGFSRDLCRGILISRSCCPRSCRARSTCGSTKRRLRCQVPPQEARLPLANMASSWRLASTSATMARSTIRNCFSMPMAVSSGARSPRLSTSGSGARAMPQAEGCRQRHWPHRRAGLLGTLQSASPYALMAQHEEIHIAQFPGSMVGPIFADQMEVTIRHHALESGCFVVNATGWRMIRSSRSHRIPACKKRCGVAAGDHFPRRQASRAAAHRRGYPRRRSTASFSSASAWIRSATMPGPSCCTSSWTPGRLRRGNRPCPLPSPAKIDNRHDRWRTGCVFRRKRSTNCSLRSPAG

SEQ ID NO: 365 - DNA, 975 bp, Unknown
  Obtained from an environmental sample
atgacaaagctagccatcgttcaaaaaccccccgtctttctggataaagaaaaaaccatagcgaagacggttgattccataaaagaggccgcgacacaaaatgccgacttggtcatcttcaccgaagccttcatcccgggctaccccacctggatatggcgacttaggccaggcgctgattggggcctctcagaagagctgcacgagcagttattgcgtaacgcggtgagtatgggatcgaccgacctggatccgctttatgaagccgcccaacagcataacgtcactattgtttgcggcatcgtagaaagagaccaccaactcagccaatcaaccctctacaacagcatggtcgtcattgacacagacggaacccttctcaacaagcaccgcaaactcatgccaactaatcccgaacgcatggtgtggggctttggcgacgcctcaggactcaaagccgttgcaacacctgcaggccgcatcagcacgttgttgtgttgggagaactacatgccattggcccgatatgctctgtatgcacaaggcgtggaaatctatatcgcgccaacttacgacagtggtgcgggttggataggaagcttgcaacacatagcacgcgaaggtcgatgctgggtcgtgggctgtggcaacctgattcaggccagtgatctgcctgaagacttcccggacaaggacaacctctacccggacgcagaagagtgggtgaacccgggtgactccatagtcattgcaccagacggtgagattgtggccggtccaatgcacaaagagacaggaattttgtactgcgagatagatctggagaaagtcagaattgcaaaacgagcattagacgtgaccgggcattattcgcgaccggacgttttcaaactgcatgtgaatacccgacctcaatcacctgtggaatttgaaggtcaggagaccaacaatccaacaacaggagaaagctcatga

SEQ ID NO: 366 - protein, 315 aa, Unknown
  Obtained from an environmental sample
MTKLAIVQKPPVFLDKEKTIAKTVIPKRPRHKMPTWSSSPKPSSRATTWIWRLRPGADWGLSEELHEQLLRRGEYGIDRPGSALSRPTARHYCLRHRRKRPPTQPINPLQQHGRHHRRNPSQQAPQTHANSRTHGVGLWRASGLKAVATPAGRISTLLCWENYMIGPICSVCTRRGNLYRANLRQWCGLDRKLATHSTRRSMLGRGLWQPDSGSDLPEDFPDKDNLYPDAEEWVNPGDSIVIAPDGEIVAGPMHKETGILYRDRSGESQNCKTSIRRDRALFATGRFQTACEYPTSITCGIRSGDQQSNNRRKLM

SEQ ID NO: 367 - DNA, 981 bp, Unknown
  Obtained from an environmental sample
atgactgcccactttgccgataccctgaccgttgccgtggcccagatcgcgccggtgtggctacagcgcgaagctaccctgcaaaagatgctggtctgggtggagcgcgccgcgcgcgaaggcgcgggcctggtcgccttcagtgagggcctgctgcctggctaccccttctggattgaacacacggacggcgcccgcttcgagtcgccgttacagaagcgcctgtacgcccactactgcgatcagtcggtccagatcaatgctgggcacctcgcaccactctgcgctgccgcggccagacaccagatttgggtggtctgcggcgtcatcgagcgcgacagcgcacgcggactcagcgtgtttgcatcaatggtcaccatcgatgccgaaggcgcgatccgcagtgtgcaccgcaagctgatgccgacctacgaagaacgcctggtgtggtcgcccggcgacgcgcacggactgcgctgccatccgctcggccagttccgcctcggcagcctcaattgctgggagaactggatgccgctggcgcgcgccgccctgtacgcccagggcgagtctttgcatgttgcatcctggcccggcagtcgccgcaacaccgagaccattactcccttcatcgcccgcgaaggccgcagttacgcgctgtccgccagttccgtgctgcaccgggatgatctgcccgactccgttccggcgctgtcggtgctgcgcgactgcctgccggacgtgatggccgacggcggctcctgcgtcgccggccccgacggacatttcctgatcgagccggtcgtcggccgggaagagctgctgctcgcgcagatcgatcatgcccgggtacgcgaggaacgtcagaacttcgaccccttcggccactactcgcggccggaactcctgtcgctggtggtggatacgcgccgggcgagcggagtgcagatagtgaatgctgaccatggctttaagccctga

SEQ ID NO: 368 - protein, 317 aa, Unknown
  Obtained from an environmental sample
MTAHFADTLTVAVAQIAPVWLQREYPAKDAGLGGARRARRRGPGRLQGPAAWLPLLDTHGRRPLRVAVTEACTPTTAISRSRSMLGTSHHSALPARHQIWVVCGVIERDSARGLSVFAQWSPSMPKARSAVCTASCRPTKNAWCGRPATRTDCAAIRSASSASAAQLLGELDAAGARRPVRPGRVFACCILARQSPQHRDHYSLHRPRRPQLRASASSVLHRDDLPDSVPALSVLRDCLRTWPTAAPASPAPTDISSSRSSPGRAAARADRSCPGTRGTSELRPLGHYSRPELLSLVVDTRRASGVQIVNADHGFKP

SEQ ID NO: 369 - DNA, 1074 bp, Unknown
  Obtained from an environmental sample
atgtccgaagagaacaccaccaccgaatcaagctcggacgcgatctggaccgttgcggccgtccaggcggcgccggtgttcttgaatcgggatgcgacggtgcgtaaggccgtctcgctgattgccgaggccgcggcgcacggcgcgcgtctcattgtttttcccgaggcgttcattccatcgtacccggattgggcgtgggcggtcccgcccggacagggcggaaccaactcgagactgtatgccaaactgctcgacaattcggttacggtgcccagcccagccaccgatgccctggccagggcggctcgcgacgcgggcgcctacgtcgtcatgggcataaacgagcggaacacggcggcgagcggcggaagtctctacaacagcttgctctatattggtccggacggtcgcatcctgggcattcatcggaagttggtgccgacctcggcggagcggctgatctgggcacaaggcgatggaagcacgcttggcgtgttcgatacgccgggcggccggcttggcggcttgatctgctgggaaaactatatgccgctggcccgatattcgatgtacgcgcgcggcgtgcaaatatatgttgcggcgacctgggacaggggcgagccatggctttcgacgctgcgacacatagccaaggaaggccagacctacgtgataggctgttgcatcgccatgcggacggccgacatcgacgacgccgagctcgtcgagaagtattacgcggacgccggtgagtggatcaatgaaggcgacagcgcgattgtcgatccgagcggaacaatcattgccggtccggcccatcagaccaatgaaatcctctacgccgcgatcgatcgccagaaggtgctggaatcaaaatggatgttggacgtggccgggcactacgcgcgtccggacgtgttttcatttggcgttcgaaccgatgccaacccgataatgaccatgaacgaaccaagcgcgacggccgagccgaggcacaatagcgcgggagccgagggtcgcgacggcctacgcgggcgtcgtgaccctcgctcgagaattcggcagatgtag

SEQ ID NO: 370 - protein, 346 aa, Unknown
  Obtained from an environmental sample
MSEENTTTESSSDAIWTVAAVQAAGVLESGCDGAGRLADCRGRGARARLIVFPEAFIPSYPDWAWAVPPGQAEPTRDCMPNCSTIRLRCPAQPPMPGQGGSRRGRLRRHGHKRAEHGGSGGSLYNSLLYIGPDGRILGIHRKLCRPRRSGSGHKAMEARLACSIRRAAGLAASAGKTICRWPDIRCTRAVQIYVAATWDRGEPWLSTLRHIAKKARPTAVASPCGRPTSTTPSSSRSITRTPVSGSMKATARLSIRAEIIAGPAHQTNEILYAAIDRQKVLEKMDVGRGRALRASGRVFIWRSNRCQPDNDHERTKRDGRAEAQRGSRVATAYAGVVTLAREFGRC

SEQ ID NO: 371 - DNA, 1014 bp, Unknown
  Obtained from an environmental sample
atgggtatcgaacatccgaagtacaaggttgcggtggtacaggcggcgccggcctggctcgatctcgacgcatcgatcgccaagaccatcgcgctgatcgaggaggcggccgccaagggcgccaagctgatcgcattccctgaggccttcattcccggctatccttggcatatctggatggactcgccggcctgggcgatcgggcgcggatttgtgcagcgctatttcgacaattcgctttcctacgacagcccgcaggccgaacggctgcggctcgcggtgaagaaggccggcatcaccgccgtgctcggcctgtccgagcgggaaggcggcagcctttatctcgcgcaatggctgatcggtcccgacggcgagaccatcgccaagcggcgcaagctgcggccgacgcatgccgagcgcaccgtctacggcgaaggcgacggcagtgaccttgcggtccatgaccgcgctgacattggccgtctcggcgcgctgtgctgctgggaacatctgcagccgctgtcgaaatacgccatgtatgcccagaacgagcaggtgcatgtcgcggcctggccgagtttttcgctgtacgacccgttcgcgccggcgctgggctgggaggtcaacaacgcggcatcccgcgtctatgcggtcgaaggctcctgcttcgtgctggcgccgtgtgccaccgtctcgcaggcgatggtggacgaactctgcgaccgcgacgacaagcatgcgctgctgcatgtcggcggcggccacgccgcgatctacggaccggacggcagctcgatggcgaacaagctcgatcccgagcaggagggcctgctgttcgccgacatcgatctcggggcgatcggggtggcaaagaacgccgccgatccggccgggcactattcgcggccggatgtgacccgtctgctcttgaacagaaaaccctcaaagcgcgtcgagcactttgcgctgccgctcgaccatctcgcggacgagggcgttgctccggtgacctga

SEQ ID NO: 372 - protein, 327 aa, Unknown
  Obtained from an environmental sample
MGIEHPKYKVAVVQAAPAWLDLDARSPRPSRSRRRPPRAPSSHSLAFIPGYPWHIWMDSPAWAIGRGFVQAISTIRFPTTARRPNGCGSRRRPHHRRARPVRAGRRQPLSRAMADRSTARPSPSGASCGRRMPSAPSTAKATAVTLRSMTALTLAVSARCAAGNLQPLSKYAMYAQNEQVHVAAWPSFAVRPVRAGAGLGGQQRGIPRLCGRGSCFVLAPCATVSQAMVDELCDRDQACAAACRRRPRRDLRTGRQLDGTSSIPSRRACCSPTSISGRSGWQRTPPIRPGTIRGRMPVCSTENPQARRALCAAARPSRGRGRCSGDL

SEQ ID NO: 373 - DNA, 1056 bp, Unknown
  Obtained from an environmental sample
atgacgaattttctggacgtgacggtggcagcggttcaggcggctcccgtctatttcgatcgggaggcatcgacggagaaagcgtgccggttgatccacgaagcggcagggctcggcgcgacgctcgcagcgttcggcgaaacctggttgccagggtatccgttcttcgtctgggggttcgcgcacaaccggagcctgttctggcaggccgccgccgagtacatcgccaatgcggtggagattccgagtcccacaacggaccgtctctgtgcggcggcgaaggctgccggggtcgacgtcgtcattggcgtcgttgaactggatgaacgaacacgagcttcggtttacagtacgctgcttttcatcggtcgcgacgggacgatcctgggccgccaccgcaagctgaagccaacacacatggagcggacgatctggggcgaaggggacgcatatggactccgcgtctacgaacgttcgtacgggcggctgagcggcctgaattgctgggaacacaatatgatgctgcccggctacgtgcttgccgcacagggcacgcagtttcacgtcgccgcatggcccggaaaggagaggctcaccgtcccgccgaacgaagcggcttatacgcgccagcttctcctctctcgcgcgtatgcatcccaggccggcgcgtacgtgatcagcgtcgccgggctgctcgcaccagactccatgcccgagcgttatcgcgagttagggcggtcatatgagttgaccggcgacagcgtcatcgtcgacccgcgcggcgaggtcattgccgggcctgcaaaaggcgagaccatcctgctcgcgcagtgcagtcaggaagctctcctcgcggccaagtccgccatcgacctcggcggccattactcacgcccggatatctttcagctgcgtgtcaacgatcaactgcagcatcgggtccggagagttgagccacacttcacggcggcgatcggacatatcggagccgagcgccgatcccaggaggatggtactggtcccttcgacctggcggaatctctcacgaactcctag

SEQ ID NO: 374 - protein, 351 aa, Unknown
  Obtained from an environmental sample
MTNFLDVTVAAVQAAPVYFDREASTEKACRLIHEAAGLGATLAAFGETWLPGYPFFVWGFAHNRSLFWQAAAEYIANAVEIPSPTTDRLCAAAKAAGVDVVIGVVELDERTRASVYSTLLFIGRDGTILGRHRKLKPTHMERTIWGEGDAYGLRVYERSYGRLSGLNCWEHNMMLPGYVLAAQGTQFHVAAWPGKERLTVPPNEAAYTRQLLLSRAYASQAGAYVISVAGLLAPDSMPERYRELGRSYELTGDSVIVDPRGEVIAGPAKGETILLAQCSQEALLAAKSAIDLGGHYSRPDIFQLRVNDQLQHRVRRVEPHFTAAIGHIGAERRSQEDGTGPFDLAESLTNS

SEQ ID NO: 375 - DNA, 939 bp, Unknown
  Obtained from an environmental sample
atgaccaaaatcgctgtcattcaagaacccccggtctatctgaatctgagcaaatcgatggaccgagcggtcgacttgattgccgatgccgcgagccaggggtgtcagttgattgtgtttcccgaagcctggcttgcaggttaccccaccttcgtctggcgtcttgcgccgggcagcggaatgggaaaaaccgatgagctttacgcgcgtttgctcgccaactcggtcgaccgcagcaaagaggggcttcggcctttgcaggaggctgcaaaagagcatggcgttgtcattgttctgggttatcaagaggtggacggctcgggcagcagcagcacaatcttcaacagctgcgcgattattgatgccgacgggcgactggccaacaaccatcgcaagttgatgcccaccaatgcggagcggatggtgtgggggtttggcgacggttcgggcctgaacgttgttgacaccgcggtgggcaggatcggcacgctgatttgctgggaaaactacatgcccttggcgcgctacgcgctgtatgcccaaaacatcgaaatctatgtggcgccgacctgggacagcggtgccatgtggcaagccaccctgcaacatatcgcacgtgaaggtggctgctgggtcatcggatgtgcaacctcgctgcaagcctctgacatcccggacgaccttccccatcgggatgagttattcccgaacaaagacgaatgggtgaaccctggcgatgcggtggtttacaaaccttttggcggccttgtggccggccccatgcatcaggaaaaggggcttctcatcgcagagttggacgtcgccgctgttcaggtctcacgtcggaagttcgatgcgaccgggcattacgctcgccccgatgtcttccaactgcacgtgaatcgcagcgcgatgcggccggttgagttcacgaattag

SEQ ID NO: 376 - protein, 312 aa, Unknown
  Obtained from an environmental sample
MTKIAVIQEPPVYLNLSKSMDRAVDLIADAASQGCQLIVFPEAWLAGYPTFVWRLAPGSGMGKTDELYARLLANSVDRSKEGLRPLQEAAKEHGVVIVLGYQEVDGSGSSSTIFNSCAIIDADGRLANNHRKLMPTNAERMVWGFGDGSGLNVVDTAVGRIGTLICWENYMPLARYALYAQNIEIYVAPTWDSGAMWQATLQHIAREGGCWVIGCATSLQASDIPDDLPHRDELFPNKDEWVNPGDAVVYKPFGGLVAGPMHQEKGLLIAELDVAAVQVSRRKFDATGHYARPDVFQLHVNRSAMRPVEFTN

SEQ ID NO: 377 - DNA, 1050 bp, Unknown
  Obtained from an environmental sample
atgtccagcaccacccatccccgcctgcgcgtcgccgcggtgcaagccgcccccgtcttcctcgacctcgacggcaccatcgacaagaccatcgacctgatggcccgggcggccggccagggcgtgcagctgatcgcctttcccgagacctgggtgcccggctatccgtggtggatctggctcgattcgccggcctggggcatgcagttcgtgcagcgctaccacgacaacgccctggtcgtcggctcgcccgagttcgaccgcattcgcgaggccgcgcgcaagcaccgcatctgggtctcgctcggctacagcgagaaggccgccggcagcctctacatcgcccaggcgctgatcgacgaccagggcaacacgctgcagactcggcgcaagctcaagccgacgcacgtggagcgcaccgtgttcggcgagggcgacggatcggacctgagcgtggtcgagacggctatcggcaacatcggctcgctgtcgtgctgggagcacctgcagccgctcagcaagtacgcgatgtactcgcagaacgagcagatccattgcggcgcctggcccagcttctcgctctaccgcggcggcgcctacgcgctcggcgccgaagtgaacaacgccgccagccaggtgtacgcggccgagggccagtgcttcgtgatcgcgccctgcgccacggtctcgaaggcgatgcacgaactgctgtgcaccgaccctggcaagcagcagatgctgctggtcggcggcggcttcgcgcgcatctacggacccgacggatcgccgctcggcaagaacctggcagaggacgaggaagggctggtggtggccgacatcgacctcggcatgatctccctggccaaggcggccggcgacccggccggccactattcgcggcccgacgtgacgcagttgctgttcaacaggaagcggcgcgagccggtggtgctgcaaggcccggccgagcccgagaaggcggtcgccgagccggtgtccacgccgagcgaagcggcggcggccgccgcccgccagccggtcgtggcctga

SEQ ID NO: 378 - protein, 349 aa, Unknown
  Obtained from an environmental sample
MSSTTHPRLRVAAVQAAPVFLDLDGTIDKTIDLMARAAGQGVQLIAFPETWVPGYPWWIWLDSPAWGMQFVQRYHDNALVVGSPEFDRIREAARKHRIWVSLGYSEKAAGSLYIAQALIDDQGNTLQTRRKLKPTHVERTVFGEGDGSDLSVVETAIGNIGSLSCWEHLQPLSKYAMYSQNEQIHCGAWPSFSLYRGGAYALGAEVNNAASQVYAAEGQCFVIAPCATVSKAMHELLCTDPGKQQMLLVGGGFARIYGPDGSPLGKNLAEDEEGLVVADIDLGMISLAKAAGDPAGHYSRPDVTQLLFNRKRREPVVLQGPAEPEKAVAEPVSTPSEAAAAAARQPVVA

SEQ ID NO: 379 - DNA, 936 bp, Unknown
  Obtained from an environmental sample
atggctaaaatagcgattgtacaaaaggcgtctgttaccttgaataaacaagaaactgtcgccagtgctgtaagagaggtagagctggcagcggcggaaggtgccgagctggtagtgtttactgaggcatttattgctgggtatccggcctggatctggcgtttgcggccaggtggtgactgggggctatctgaagatcttcattcccgtttgttgacaagcgccgtagacctgggtggtgatgacctggatccactttatgccgcagctaaagaaaataacgtgacgatagtgtgcggtattaatgaacgtgataaccggctcagtaaggcaacgctatataattctatcgttattattggttccgatggttcattgttaaatcgacatcgtaagttgatgccgacgaatccggagagaatggtatggggctttggtgatgcctctggtctgaaggtcgttgatacccccgttggtcgtgttggtacgcttgtctgttgggaaaactatatgcccttggccagatatgcgttgtattcgcagggggtagaggtttatattgcgccgacctacgatagcggtgatgactggatttctacattacagcatattgccagggagggtcgttgttgggttgttggctgtggcaatctattgcgtggcagcgatataccggatgacttccctgagaagttggcgttatacccagatgaggatgagtggataaatcctggggattccgttgtgattgcacctgggggtaaaatcatggccgggccattgcgccaggaggcggggattgtctattgtgatattgcgtctgaaagtgccagtcaggcaaaacgtgcgctggatgtggctggacattattcccggcctgatatctttgagttgcatgtgaatacgaaggtgcagaccccggttgtatatgattag

SEQ ID NO: 380 - protein, 311 aa, Unknown
  Obtained from an environmental sample
MAKIAIVQKASVTLNKQETVASAVREVELAAAEGAELVVFTEAFIAGYPAWIWRLRPGGDWGLSEDLHSRLLTSAVDLGGDDLDPLYAAAKENNVTIVCGINERDNRLSKATLYNSIVIIGSDGSLLNRHRKLMPTNPERMVWGFGDASGLKVVDTPVGRVGTLVCWENYMPLARYALYSQGVEVYIAPTYDSGDDWISTLQHIAREGRCWVVGCGNLLRGSDIPDDFPEKLALYPDEDEWINPGDSVVIAPGGKIMAGPLRQEAGIVYCDIASESASQAKRALDVAGHYSRPDIFELHVNTKVQTPVVYD

SEQ ID NO: 381 - DNA, 945 bp, Clostridium acetobutylicum ATCC 3625
atgggcgaattcggtgaagttaccctgggcgtggctcaggctgctcccgtgtactttgaccgcgaggcctcgaccgagaaagcctgtggcctgatccgcgaggcgggcgaaaagggtgtagatcttctggcgttcggtgaaacgtggttaaccggctatccatactggaaagatgcgccttggtctcgcgaatacaacgacttgcgtgcacgttatgttgcgaacggtgtgatgattcctggtccggaaacggacgctctgtgccaagcagccgcggaagcaggtgtggatgtggcgatcggagtagtagaactggagccgggctctctttcctcggtttattgcactctgttatttataagccgcgagggcgagatcctgggtcgtcaccgcaaactgaaaccgaccgatagcgaacgtcgttactggtctgaaggcgacgcgactggtctgcgcgtttatgagcgcccatatggtcggcttagcggcctgaattgctgggagcacactatgatgctgccggggtacgccctggcggcgcagggcacccagttccatgtggccgcttggccaaacatggcatcctcgaattctgaacttctgtctcgtgcctacgctatgcaggcgggctgctacgttttatgcgcgggtggcctgggcccggccccaggtgaactgccggatggtatcgcggcggaaagtttagatcacttgactggagagtcatgtatcatcgacccgtgggggaaagtaattgctggtccggtgtcttgcgaggaaacccttatcacggctcgcgttagcaccgcatctatttatcgccgcaaaagtttgacggacgtgggcggtcattatagccgcccggatgttttccgttttgaagtcgatcgctctgagcgtccccgtgtcgtgtttcgcgatggtgacgtggatgaccgaggttaa

SEQ ID NO: 382 - protein, 314 aa, Clostridium acetobutylicum ATCC 3625
MGEFGEVTLGVAQAAPVYFDREASTEKACGLIREAGEKGVDLLAFGETWLTGYPYWKDAPWSREYNDLRARYVANGVMIPGPETDALCQAAAEAGVDVAIGVVELEPGSLSSVYCTLLFISREGEILGRHRKLKPTDSERRYWSEGDATGLRVYERPYGRLSGLNCWEHTMMLPGYALAAQGTQFHVAAWPNMASSNSELLSRAYAMQAGCYVLCAGGLGPAPGELPDGIAAESLDHLTGESCIIDPWGKVIAGPVSCEETLITARVSTASIYRRKSLTDVGGHYSRPDVFRFEVDRSERPRVVFRDGDVDDRG

SEQ ID NO: 383 - DNA, 1041 bp, Unknown
  Obtained from an environmental sample
atgtcggagcccatgacgaagtatcgcggcgcggcggtgcaggccgcgccggtgttcctcgatctcgaccgcacagtcgagaaagcgatcggcctgatcgagcaggcggccaagcaggacgtgcgcctgatcgcattcccagagacttggattcccggctatcccttttggatatggctgggcgcgccggcttggggcatgcgcttcgtccagcgctatttcgagaattcgctcgtgcgcggcagcaagcagtggcaggccctggcggatgcggcccgccgccacggcatgcatgtcgtggccggctatagcgagcgcgcgggcggcagcctctatatgggccaggcgatcttcggccccgatggcgatctgatcgccgcgcgccgcaagctcaagcctacccatgcggagcgcaccgtgttcggcgagggagacggcagccatctcgcggtgcacgataccgccatcgggcgcctcggcgcgctctgttgctgggagcacatccagccattgtcgaaatacgccatgtacgccgccgacgaacaggtccacgtcgcgtcgtggccgagcttcagcctctatcgcggcatggcctatgcgctcggaccggaggtcaataccgccgcaagccagatctacgcggtcgagggcggctgctacgtgctggcgtcgtgcgcgaccgtttcgccggagatgatcaaggtattggtggatacgcccgacaaggagatgttcctcaaggccggcggcggttttgccatgattttcgggcccgacggccgcgccctggccgagccgctcccggagaccgaagagggactgctggtcgccgatatcgacctcggcatgatcgcgttggccaaggcggcggccgatccggcgggccactattcacggcccgacgtaacgcggctgctgctggatcgacgtccggcccaacgcgtcgtcacgcttgatgccgcattcgaaccgcaaaacgaggacaagggcgacgcgcccgcgctgcgcgtggtggcggaaagcgccgccgccgcgcagtag

SEQ ID NO: 384 - protein, 346 aa, Unknown
  Obtained from an environmental sample
MSEPMTKYRGAAVQAAPVFLDLDRTVEKAIGLIEQAAKQDVRLIAFPETWIPGYPFWIWLGAPAWGMRFVQRYFENSLVRGSKQWQALADAARRHGMHVVAGYSERAGGSLYMGQAIFGPDGDLIAARRKLKPTHAERTVFGEGDGSHLAVHDTAIGRLGALCCWEHIQPLSKYAMYAADEQVHVASWPSFSLYRGMAYALGPEVNTAASQIYAVEGGCYVLASCATVSPEMIKVLVDTPDKEMFLKAGGGFAMIFGPDGRALAEPLPETEEGLLVADIDLGMIALAKAAADPAGHYSRPDVTRLLLDRRPAQRVVTLDAAFEPQNEDKGDAPALRVVAESAAAAQ

SEQ ID NO: 385 - DNA, 1014 bp, Unknown
  Obtained from an environmental sample
atgaaagaagctatcaaggtcgcctgcgtgcaagccgccccgatctacatggatttgaaggcgacggtggacaaaaccattgagttgatggaagaagcagcacgtaataatgctcgtctgatcgcctttccggaaacttggattccaggctacccatggtttctttggcttgactcaccagcatgggcaatgcaatttgtacgccaataccatgagaactcattggagttggatggccctcaagctaagcgcatttcagatgcagccaagcggttgggaatcatggtcaccctggggatgagtgaacgggtcggtggcaccctttacatcagtcagtggttcataggcgataatggtgacaccattggggcccggcgaaagttgaaacctacttttgttgaacgtactttgttcggcgaaggggatggttcatcgctagcggttttcgagacgtctgttggaaggctgggtggcttatgctgttgggagcaccttcaaccgctaacaaaatacgctttgtatgcacaaaatgaagagattcattgtgcggcttggccgagctttagcctttatcctaatgcggcgaaagccctggggcctgatgtcaatgtagcggcctctcgaatctatgccgttgaagggcaatgcttcgtactagcgtcgtgtgcgctcgtttcacaatccatgatcgatatgctttgtacagatgacgaaaagcatgcgttgcttctggctggtggtggacactcacgtatcatagggcctgatggtggtgacttggtcgcgcctcttgccgaaaatgaagagggtattctctacgcaaaccttgatcctggagtacgcatccttgctaaaatggcggcagaccctgctggtcattattcccgtcccgacattactcgcttgctaatagatcgcagccctaaattaccggtagttgaaattgaaggtgatcttcgtccttacgctttgggtaaagcgtctgagacgggtgcgcaactcgaagaaatttga

SEQ ID NO: 386 - protein, 337 aa, Unknown
  Obtained from an environmental sample
MKEAIKVACVQAAPIYMDLKATVDKTIELMEEAARNNARLIAFPETWIPGYPWFLWLDSPAWAMQFVRQYHENSLELDGPQAKRISDAAKRLGIMVTLGMSERVGGTLYISQWFIGDNGDTIGARRKLKPTFVERTLFGEGDGSSLAVFETSVGRLGGLCCWEHLQPLTKYALYAQNEEIHCAAWPSFSLYPNAAKALGPDVNVAASRIYAVEGQCFVLASCALVSQSMIDMLCTDDEKHALLLAGGGHSRIIGPDGGDLVAPLAENEEGILYANLDPGVRILAKMAADPAGHYSRPDITRLLIDRSPKLPVVEIEGDLRPYALGKASETGAQLEEI

What is claimed is:

1. A method for making (R)-ethyl-4-cyano-3-hydroxybutyrate, comprising
   (a) providing an epichlorohydrin;
   (b) providing a polypeptide having an amino acid sequence with at least 80% sequence identity to SEQ ID NO:210 and having nitrilase activity
   (c) preparing a 3-hydroxyglutaronitrile (HGN) from the epichlorohydrin, followed by the addition of a neutralizing agent, a buffer or a diluent,
   wherein the epichlorohydrin is converted to 3-hydroxyglutaronitrile (HGN) by cyanide treatment;
   (d) catalyzing the conversion of the 3-hydroxyglutaronitrile (HGN) to 4-cyano-3-hydroxybutyric acid by contacting the 3-hydroxyglutaronitrile (HGN) with the polypeptide of step (b);
   (e) isolating the 4-cyano-3-hydroxybutyric acid made in step (d) by crystallization using a protocol comprising:
      (1) adding concentrated potassium hydroxide or calcium hydroxide to the 4-cyano-3-hydroxybutyric acid, followed by concentration of the solution and crystallization precipitation using a hot alcohol, or
      (2) converting the 4-cyano-3-hydroxybutyric acid to its potassium salt by reaction with potassium hydroxide in water or an alcohol, followed by crystallization of the 4-cyano-3-hydroxybutyric acid potassium salt; or
      (3) the protocol of (e)(1) or (e)(2) further comprising a second or additional recrystallization after re-suspension of the crystals formed in (e)(1) or (e)(2); and
   (f) converting the crystallization precipitate to (R)-Ethyl-4-Cyano-3-Hydroxybutyrate by esterification using an acid catalyst.

2. The method of claim 1, wherein the polypeptide of step (b) is an isolated, synthetic, or recombinant nitrilase.

3. The method of claim 1, wherein the acid catalyst esterification of the (R)-Ethyl-4-Cyano-3-Hydroxybutyrate comprises use of a hydrochloric acid (HCl) catalyst or a sulfuric acid ($H_2SO_4$) catalyst.

4. The method of claim 1, wherein the reaction is a one-pot reaction.

5. The method of claim 1, wherein at least two steps of the reaction take place in sequential pots.

6. The method of claim 1, wherein the preparing of the 3-hydroxyglutaronitrile (HGN) from the epichlorohydrin comprises adding the epichlorohydrin to an aqueous solution of potassium cyanide (KCN) at an alkaline pH.

7. The method of claim 1, wherein hydroxyglutaronitrile (HGN) is converted to 4-cyano-3-hydroxybutyric acid with the polypeptide of step (b) under conditions comprising:
(a) adding to an HGN-comprising pH neutral phosphate buffered solution a cell lysate comprising a recombinantly expressed polypeptide having nitrilase activity, wherein the polypeptide catalyzes the hydrolysis of the HGN to produce 4-cyano-3-hydroxybutyric acid; or,
(b) the method of (a), wherein the 4-cyano-3-hydroxybutyric acid-comprising hydrolysis solution is acidified and the 4-cyano-3-hydroxybutyric acid extracted and isolated as an oil.

8. The method of claim 1, wherein the polypeptide of step (b) comprises the sequence as set forth in SEQ ID NO:210 and having a mutation at residue 190 from alanine to a histidine residue.

9. The method of claim 1, wherein the polypeptide of step (b) comprises the sequence as set forth in SEQ ID NO:210 having a mutation at residue 190, wherein alanine at position 190 is replaced with an amino acid capable of receiving or donating a hydrogen bond.

10. The method of claim 1, wherein the polypeptide of step (b) comprises the sequence as set forth in SEQ ID NO: 210 and having a mutation at residue 190, wherein alanine at position 190 is replaced with a hydrophobic amino acid.

11. The method of claim 1, wherein the polypeptide of step (b) comprises the sequence as set forth in SEQ ID NO:210 and having one or more mutations at amino acid residue 55 from alanine to a lysine, glycine, or glutamine; at amino acid residue 60 from isoleucine to a glutamic acid; at amino acid residue 111 from asparagine to a serine, at amino acid residue 190 from alanine to a serine, histidine, tyrosine or threonine; at amino acid residue 191 from phenylalanine to a leucine, valine, methionine, aspartic acid, glycine, glutamic acid, tyrosine or threonine; at amino acid residue 199 from methionine to a glutamic acid or leucine; or at amino acid residue 222 from aspartic acid to a leucine.

12. The method of claim 1, wherein the polypeptide having nitrilase activity is encoded by a nucleic acid having a sequence with at least 95% sequence identity to SEQ ID NO:209.

13. The method of claim 1, wherein the nitrilase polypeptide has a sequence with at least 90% sequence identity to SEQ ID NO:210.

14. The method of claim 13, wherein the nitrilase polypeptide has a sequence with at least 95% sequence identity to SEQ ID NO:210.

15. The method of claim 14, wherein the nitrilase polypeptide has a sequence with at least 98% sequence identity to SEQ ID NO:210.

16. A method for making (R)-ethyl-4-cyano-3-hydroxybutyrate comprising
(A) (a) providing an epichlorohydrin;
(b) providing a polypeptide having an amino acid sequence with at least 80% identity to SEQ ID NO:210 and having nitrilase activity;
(c) preparing a 3-hydroxyglutaronitrile (HGN) from the epichlorohydrin, followed by the addition of a neutralizing agent, a buffer or a diluent,
wherein the epichlorohydrin is converted to 3-hydroxyglutaronitrile (HGN) by cyanide treatment under pH and temperature control, and the conversion process comprises adding the epichlorohydrin to an aqueous solution of potassium cyanide (KCN) at an alkaline pH;
(d) without any purification of the HGN made in step (c), catalyzing the conversion of the 3-hydroxyglutaronitrile (HGN) to 4-cyano-3-hydroxybutyric acid by contacting the 3-hydroxyglutaronitrile (HGN) with the polypeptide of step (b) under conditions comprising:
(1) adding to an HGN-comprising pH neutral phosphate buffered solution a cell lysate comprising a recombinantly expressed polypeptide of step (b), wherein the polypeptide catalyzes the hydrolysis of the HGN to produce 4-cyano-3-hydroxybutyric acid; or,
(2) the method of (a), wherein the 4-cyano-3-hydroxybutyric acid-comprising hydrolysis solution is acidified and the 4-cyano-3-hydroxybutyric acid extracted and isolated as an oil;
(e) isolating the 4-cyano-3-hydroxybutyric acid made in step (d) by crystallization using a protocol comprising:
(1) adding concentrated potassium hydroxide or calcium hydroxide to the 4-cyano-3-hydroxybutyric acid, followed by concentration of the solution and crystallization precipitation using hot ethanol, or
(2) converting the 4-cyano-3-hydroxybutyric acid to its potassium salt by reaction with potassium hydroxide in water, methanol or ethanol, followed by crystallization of the 4-cyano-3-hydroxybutyric acid potassium salt; or
(3) a second or additional recrystallization after re-suspension of the crystals formed in (e)(1) or (e)(2); and
(f) converting the crystallization precipitate to (R)-Ethyl-4-Cyano-3-Hydroxybutyrate by esterification using an acid catalyst,
wherein the acid catalyst esterification of the (R)-Ethyl-4-Cyano-3-Hydroxybutyrate comprises use of a hydrochloric acid (HCl) catalyst or a sulfuric acid ($H_2SO_4$) catalyst.

17. The method of claim 16, wherein the reaction is a one-pot reaction.

18. The method of claim 16, wherein at least two steps of the reaction take place in sequential pots.

19. The method of claim 16, further comprising converting the 4-cyano-3-hydroxybutyric acid to its potassium salt by reaction with a potassium hydroxide in water, methanol or ethanol.

20. The method of claim 15, wherein the nitrilase polypeptide has a sequence that has 100% sequence identity to SEQ ID NO:210, or has a sequence as set forth in SEQ ID NO:210 with a residue change comprising A190H.

21. The method of claim 16, wherein the recombinant nitrilase polypeptide is encoded by a nucleic acid having a sequence with at least 90% sequence identity to SEQ ID NO:209.

22. The method of claim 21, wherein the recombinant nitrilase polypeptide is encoded by a nucleic acid having a sequence with at least 95% sequence identity to SEQ ID NO:209.

23. The method of claim 22, wherein the recombinant nitrilase polypeptide is encoded by a nucleic acid having a sequence with at least 98% sequence identity to SEQ ID NO:209.

24. The method of claim 23, wherein the recombinant nitrilase polypeptide is encoded by a nucleic acid having a sequence with at least 99% sequence identity to SEQ ID NO:209.

25. The method of claim 24, wherein the recombinant nitrilase polypeptide is encoded by a nucleic acid having 100% sequence identity to SEQ ID NO:209, or has a sequence as set forth in SEQ ID NO:209 but encoding a polypeptide with an amino acid residue change A190H.

26. The method of claim 16, wherein the recombinant nitrilase polypeptide has a sequence with at least 90% sequence identity to SEQ ID NO:210.

27. The method of claim 1, wherein the alcohol comprises a methanol or an ethanol.

28. The method of claim 1, wherein the 4-cyano-3-hydroxybutyric acid generated in step (d) has a chiral purity of at least 90% ee.

29. A method for making 4-cyano-3-hydroxybutyric acid comprising
(A) (a) providing an epichlorohydrin;
(b) providing a polypeptide having an amino acid sequence with at least 80% identity to SEQ ID NO:210 and having nitrilase activity;
(c) preparing a 3-hydroxyglutaronitrile (HGN) from the epichlorohydrin, followed by the addition of a neutralizing agent, a buffer or a diluent,
wherein the epichlorohydrin is converted to 3-hydroxyglutaronitrile (HGN) by cyanide treatment under pH and temperature control, and the conversion process comprises adding the epichlorohydrin to an aqueous solution of potassium cyanide (KCN) at an alkaline pH;
(d) without any purification of the HGN made in step (c), catalyzing the conversion of the 3-hydroxyglutaronitrile (HGN) to 4-cyano-3-hydroxybutyric acid by contacting the 3-hydroxyglutaronitrile (HGN) with the polypeptide of step (b) under conditions comprising:
(1) adding to an HGN-comprising pH neutral phosphate buffered solution a cell lysate comprising a recombinantly expressed polypeptide having nitrilase activity, wherein the polypeptide catalyzes the hydrolysis of the HGN to produce 4-cyano-3-hydroxybutyric acid; or,
(2) the method of (a), wherein the 4-cyano-3-hydroxybutyric acid-comprising hydrolysis solution is acidified and the 4-cyano-3-hydroxybutyric acid extracted and isolated as an oil.

30. The method of claim 29, further comprising isolating the 4-cyano-3-hydroxybutyric acid made in step (d) by crystallization using a protocol comprising:
(1) adding concentrated potassium hydroxide or calcium hydroxide to the 4-cyano-3-hydroxybutyric acid, followed by concentration of the solution and crystallization precipitation using hot ethanol, or
(2) converting the 4-cyano-3-hydroxybutyric acid to its potassium salt by reaction with potassium hydroxide in water, methanol or ethanol, followed by crystallization of the 4-cyano-3-hydroxybutyric acid potassium salt; or
(3) a second or additional recrystallization after re-suspension of the crystals formed in (e)(1) or (e)(2).

31. The method of claim 30, further comprising converting the crystallization precipitate to an ethyl-4-cyano-3-hydroxybutyrate by esterification using an acid catalyst.

32. The method of claim 31, wherein the acid catalyst esterification of the ethyl-4-cyano-3-hydroxybutyrate comprises use of a hydrochloric acid (HCl) catalyst or a sulfuric acid ($H_2SO_4$) catalyst.

* * * * *